United States Patent 11,098,302 (IDENTIFICATION OF POLYNUCLEOTIDES ASSOCIATED WITH A SAMPLE) - sequence listing, part 62

SEQ ID NO: 213147 - DNA, 696 bp, Homo sapiens
  misc_feature: GYAE6OF02G445A.21.27.C05.1.454.CMB.1.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
  modified_base (428)..(428): a, c, t, g, unknown or other
  misc_feature (428)..(428): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggacnccgccaccctctcctgccacgacgccagtcagtctatcgctgacttggttacgccgtggtaccagacgaagaaacgtcgtcggaccaggcctacccgaggtcctcctctactttaccggngcctactcccaccgacgggccctacgtcggtccgtacccgagtacgtacggttaccgaggtcgggacgggttaggtagtttcggggaactaggttacgttttccnccgtaccgaccgtagtaccgacggtccctacccgtaagacggtaggttagaacgtagttcgggttacgtacgtttagttttacttaccgtcgtacctaagtaactaagtttaacgttaacgtttaccggtcgtccgttcggtaccggttaccggttacccggttaccgggacccgtacgggaaccggtaagggtacggtaacctaaccggaaacgtacgttcgggacgtccgtacgaccgtaccgtacgttccttagttcccttaccg

SEQ ID NO: 213148 - DNA, 718 bp, Homo sapiens
  misc_feature: GYAE6OF02F20TV.21.27.C05.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctttctctggcctcccagaccaccactggagtgattgtgatgacgcagtcctccagcctaccctgtctgtgtctccggagggggacnccgcccacccttctcctgcacagccagtcagtctatcgactgacttggtagccgtggtaccagccaagaatcgtcggccacggcctacccgaggcctcctactagtttaccgtgctactaccgaccgacgggcctacgtcggtaccgtccagaaccgtgtcctaggtcgggtcgggtaggtacggtttgggactaggttacgttttcacttacctacctatccacggacccgtacccgtacgacgaaggttacgaaagtacttggttcggtacgtttaacgtttttagttaccgtcgtaccgtaacgtactaacgtttaagttaaccttacgggttaccgtacccgtttacggtccggttaccggttaccggttaccgggtaaccccgggaacgggtaacccggtaacgggttacggtaaaacgttaaccggaaaccgggtttaaccggtcggtaccggtccgttaacggacccgtacccggactttaccggtcgttaaccgtttcccg

SEQ ID NO: 213149 - DNA, 779 bp, Homo sapiens
  misc_feature: GYAE6OF02JYAWG.21.27.C05.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattggtgatgacgnagtcctccagcccacctgtctgtgtcctcggaggggacncgcctaccctcncctgcacgacgccagtaccgacgtctactcgccgtagtaccgttgggttacgtccgtacggtaccagacgaagtaaactcgtacggaccgagccgtacccgacggtccctacctacgttcgttaaccgtgaccgtaacctcccgtaaccgaccgggtacctaccgttcggtaccggtacccgaaggtacgtacggttcgacgggttcgggtcggttaggttacgggtttaggacgttaggtttctttacccgtctaccgtaccgtacttacgacgtcccgtaacctaacgaagggttacgtaaggtaaacgttggtttacgtcggttatttacgtttacttcgtactaccgtaagtaccgttaaattttaacgtaacgtttaccgttcggtaaccggtcggttaccggttccggttaacggtcccggtaaaaccgggttaaccgggtaaaccggtagggtaaaccggtaacggtaaaccggttaaaccttaacgggtacggtaccggtaccgtaaccgtaacgttaccgtacgggtttacccttacgttaccgtttacccgg

SEQ ID NO: 213150 - DNA, 644 bp, Homo sapiens
  misc_feature: GYAE6OF02FH33I.21.27.C05.1.454.CMB.1.raw
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (409)..(409): a, c, t, g, unknown or other
  misc_feature (409)..(409): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttacncctggtaccagcagaaatctggccaggcctcccaggtcctccgtctacttttaccgtgccactcccaccgacgggcccaacgtgggtcctacccaggtacctaaggtttccaagggtcgggtcgggttgggtacgtttggggactaggtacgttttcnctccacatccagccgaccctacagtagtagaagtagttgttagcttaaggtttactttctgaccctagactaaattacttaattacgtcggtccttggtaccgttcgtaccgtttccgggaccgtaacggggtaaccgtaagggtaacggtaaacgttaaaccgaaaaccggtaaccgttcggtacggtaccgttacgaacccgtaaccgtaagttcccgttacgttaccttacc

SEQ ID NO: 213151 - DNA, 661 bp, Homo sapiens
  misc_feature: GYAE6OF02G2Q6B.21.27.C05.1.454.CMB.1.raw
  modified_base (202)..(202): a, c, t, g, unknown or other
  misc_feature (202)..(202): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
  modified_base (403)..(403): a, c, t, g, unknown or other
  misc_feature (403)..(403): n is a, c, g, or t
  modified_base (456)..(456): a, c, t, g, unknown or other
  misc_feature (456)..(456): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggganccgccaccctctcctgcactagccagtcagtctatcgctgactggtacgcctggtaccagcaagaatcgngaccacggcctcccgaggcctcctactacgttttaccgngactactcccacgacgggccctagtcggtcgtacccgagacctggttcgaggtgggccggtaggtagtttggggaactaggttacgttttcncttacgacctattccgacggccctacccgtaagacggtaggtacgaaacgttntcggttcgtacgttaagttttacgttacgtcgtacgtacgtactaattaacttaacgttcgtcggtccttggtaccgttacgtaccggtttccggacccggtaaccgggaccggtaacggtacggtaaactaaccggaaaaccggtacgttcggtacggtaccgtacgtacccgtaacctacttcggttaccgttaccttaaccg

SEQ ID NO: 213152 - DNA, 977 bp, Homo sapiens
  misc_feature: GYAE6OF02GZDJP.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtgggtgtcctgtcacagatacaaactacagcagtctggtccaggactggtgacggccctcgcacgtacccttcactcacctgtagacactccgtaccggggaaaattcgtccgcgttggacctaaacgtaacgttgggttaggtaaacgtttaggggtaagtttaacgggaccgtaaccggttaccccccggttacggaacgggtacgggtacccctttaggaaggttccgggtacgttaggggtaaacggtaacccgttacgtttaaacgtacccggttaccccgtaggttacgggtagttaacggtaaacggtaacttaagtacgtacgtaagtacgttttacgtagggttagaacggttccggggtttaccgttaccgttacccgtacccgtaacgtttaaccccgaaaccccccgtaaaggtaacccgtaaacccgggttaaacccgtaaaacggttaaaccgttaccggtaaacccgggttaccccctttaaccccgttaccccgtaaacccgtttaaaacgttcccgtttaaccgttacccggtttaccccgtaaacccggtttacccccgggaaaccccgtttaacccgggtaaacccgggttacccgtttttaacgggttttttttaaccgtttttacgggtacccggtaaccggttaaaaccggggttaccggttaaaccggtttacccgtaaaccgttaccgggtttttaaccggtaacccggttaaccctttacccggtttacccggtttaccggtaccccgtttaaccgggtcccgggggtaacccggttaacgggggttttaaccccggg

SEQ ID NO: 213153 - DNA, 741 bp, Homo sapiens
  misc_feature: GYAE6OF02GW6HR.21.27.C05.1.454.CMB.1.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgcagtctccagccaccctgtctgtgtctccgagggggganccgccaccctctcctgcacacgaccagtcagtctatcgctgacgtggtacgcgtgtaccagacaagtaaactntacggccaggcctacccgaggtcctcctactacttttaccgcgtacactacccgaccgacgggtccaacgttcggtcgtacccgagacgtaggttcgagtcgggtcggtacggtagtttcgggaactaggttagttttacctccgttaaccaaccgtaattcccgacggtacccgtaccccgttaagacgtaacggtacggaaagtacgtttacgttacggtactttaaggtttttacttacgtacggtacccgtaaacgtagttaaaccttaatttaaaccgttacgtacgggtacctttccgggtaccggttacccggtttaaccgggttcccgggtaacccggtaaaccggggtacccggtaaagggttaaccggttaaaacgtaaccggtaaaaccggtaggttaccggtacggtaccgtacgacccgttaacgtacgttccgttacgttaccttacccgg

SEQ ID NO: 213154 - DNA, 603 bp, Homo sapiens
  misc_feature: GYAE6OF02FUL7M.21.27.C05.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccaccctgtctgtgtctccaggggggancgccaccctctcctgcacagccagtcagtctancgctgactggttancctggtaccagcaagaaatctggccaggcctcccgaggctcctctatttaccgctactccaacgaggcctagtcggtcgtaccagactaggtcaggtggcggtagtagttggactagttacgtttcnctacactntcgacgacgtacctagacgtagtagaagtgttgtagtacgttagtttattcgtacgactagtactaaattaataacgttacgtacggtcctcggtcgttaccgtaccggttccggtaccgaaccgggtaaccgtaagggtaacgtaaacgtaaccggtaaaccgtacggttacggtacgtaccgttacggacctaaccgtacttccgttacgttccttac

SEQ ID NO: 213155 - DNA, 743 bp, Homo sapiens
  misc_feature: GYAE6OF02FET5A.21.27.C05.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatctcctgcccgtgctgggcctcccagtggggtntccctggtcacagactcaaactacagcagtctggccaggactggtcgacggccctcgcacgaccctttcacctcacctgtcgactacgtcgtaccggggaaatcgtcgcttaggcaacgaagttgggtagaattggattacggctaccggtcccgtagagtacggtccttaggacgtggtacgttaggaacggtacctagttaactaccggtccgtaggttacggtagtacggaaacgtaccttaagtccggtagtaacggttaagttcctaagggttcgaacgggtccggttaccgtactaccaccgttacacccaaaccccgcgtaaccgtaacccgtaccgtaaaagtaccgacctaacgggttccctaccccgttaccgttaactaacgtcgtaccgttacgcccgtacccgtaccggtaacgtaccgtaaccgggtttactttttacggtttaaactttcgggttaaccacggttaaaacgggtcggttaacctaccgttaactaaccggtttacgggaacccttacgttacccgtcttacggaccgtaccggtcgggttaccgtacgggttaacccg

SEQ ID NO: 213156 - DNA, 669 bp, Homo sapiens
  misc_feature: GYAE6OF02HRUS0.21.27.C05.1.454.CMB.1.raw
  modified_base (378)..(378): a, c, t, g, unknown or other
  misc_feature (378)..(378): n is a, c, g, or t
  modified_base (548)..(548): a, c, t, g, unknown or other
  misc_feature (548)..(548): n is a, c, g, or t
tcagtcgtcgctcgcacgaccggtgctcgatttagacgcgatcgaagggtttgggggggaagaggaagactgacggtcctgccacaggtggtgctgggcacggtgggccctcgcagaccctttcactcacctgtgacatctccggggaaaatgtcgctggacaacaatggttggaattggattaggcagtcccgtcgagagccttgagtggcttggaaggacctattatacgtcccagtggtatgaagactatgcagattctgtgagcggtcgtctcaccatcaccccagacacgtaccaaagaactcaaggtccttacccctaccgacctaaatcgtactcgtcactcccgacgaaccacggctagtttatttttgngtacaaggtagggattacaactacgtttacggtacgaaccttaaccttccgttacgtaaccttcccgtcgggggaccctaagggggtaaccgtttttgtccgtaccgtctcccgttacacgtccctaccgaaccgtaacggggaccctagtccggtttaccttcccccgngggcccgtacccttcgacccttccggaaggaccgccacctacccggtagaccgcaacgccggccggtccccgtgggcccttgcccgttagaccgaaggtacctaccgttccctcgttaccc

SEQ ID NO: 213157 - DNA, 772 bp, Homo sapiens
  misc_feature: GYAE6OF02GMH7D.21.27.C05.1.454.CMB.1.raw
  modified_base (161)..(161): a, c, t, g, unknown or other
  misc_feature (161)..(161): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctcctcctcatcttcctgcccgtgctcgggcctcccagtggggtntcctgtcacagatacaaactacagcagtcgtggtaccgaggacgtgggtgacggcccctcgaccacgtaccccttcacctcctaaccgtggtacacacgtaccggtaaccgggggaaaattcgggtcgcgttagggacctaaacgaaagttgggttagggtaagtttgggtaacgtttagggacccgtaccggtttaccccccggtacggtaacggacggtcccgtttagggtacggtacgggttaccggtttaggtaaacggtaacccgttaagtttaacctaccggttacctaggttaggttaacttaggaacgtacttagcgtagtacgtagtttcttagggacggtacgggtcgggttaccgtccgtaccaacccgttaccgacccctaaccgaacgaaccgtaaccgtaacccgaaagtaacccacggtaccgtaccgttacccgacctaacttacgtcgtactcgtacccacgtacccgaagtccgaacgttccgttagttttactttagccgtaacgaggacgtagccgtttaagaccgttacgtaccgtaacctttccggttcctacgtacccgttacgggaccgggacgtaacggtttccgg

SEQ ID NO: 213158 - DNA, 895 bp, Homo sapiens
  misc_feature: GYAE6OF02HZ4SQ.21.27.C05.1.454.CMB.1.raw
  modified_base (218)..(218): a, c, t, g, unknown or other
  misc_feature (218)..(218): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (879)..(879): a, c, t, g, unknown or other
  misc_feature (879)..(879): n is a, c, g, or t
tcagtcgtcgctcgcacgaccggtgctcgatttagacgcgatcgaagggtttggggagaactgctcagttaggacccagacggagccatggaagcccccagcgcagcttctcttcctcctgcttctctcggcctcccagaccaccactggagtgattgtgatcggacgctagtcctaccacgccctacccgtgtctgttgtcgtaccgaggggggacncgcccaccctcgtcctgaccactacgccngttcagttctagtccgnttcgagttcggttagtcccgtaggtaaccgtagacgaaagaactcggtcggacccgacgggtcctacccgaccgggtaccctttccgttaaccgtttaccggtttaaccccggtgttaaccctaacccgttaccccgtaaccccgggtaacggggtacccccggttaaggtttccgggttaccccgtaaccccggtaaacgggtaacccggttacgggttttaaccccggaagggggtttccggggttaacggggtttccgggttttaaggggttttacgggggtacgttaacgtttttaaggtttttcccgtaacccggttaccccgtaaaccgtaccgttaccgaccggtaaccccgtccccggtaaaaggtacggtaccggttaaggtaaagtacgtttaggttcgtaacgttttaggttttaacgtttacgtcccgtaaccgttagtaacttaaaccgtttaaacgttaacgtttcgggtacccggttcgttaccggttacccgttacgggttcccgtaccgggtacctaaaccggggttctaaagggccgttaaacgaactaaccgggttacgtacgggtacgtccgtacgtaacctacgttaccggttnttcgttacccttaccg

SEQ ID NO: 213159 - DNA, 543 bp, Homo sapiens
  misc_feature: GYAE6OF02F5AXQ.21.27.C05.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccaccctctcctgcacagccagtcagtctatcgctgactggttagccttggtaccagcaagaaactcgtggccgaggcctacccgaggctcctctatttaccgtgctactcccaccgagggcccacgtcggtcgtcccagtacaggttcaggtggcggtggattggganagtgttttcnctcacctatcagccgaccctacagagtgaacgtgtgttgattagttttattctagcctagactaattattaatactggcctgcgttccgacgttccggcgacgggacgtaggtacgaagtacgaaacgagtgtcggtcgngacactatcgttcgtnttacg

SEQ ID NO: 213160 - DNA, 804 bp, Homo sapiens
  misc_feature: GYAE6OF02JC38Q.21.27.C05.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccacctctcctgcacagccagtcagtctatcgctgacgtggttacgcctgggtaccaggtcaagaaactctcgggccaggcctcccaggcctcctctactttaccgngccactcccgaccgagggcccagtcgggtcgtccccgagaccgtggtttaccgagggtcggcgggttagggtagttttcgggggaactagggttacgtttttcgccttaccgaaccgtattccgaacgtcccgtaccccgttaacgacggtaacggtaggaaacgtagttcggtttacggtacgtttaaaggtttttacttttacccgtggtaaccccgtagtaaccgttaaaatttaacgtttaaaccggtttaccgttaccgggtccgttaccgggttacccgggtttaccgggttaacccgggtttcccggggtaaccccgtaaccggggggttaacccgtaacgggggttaaccggtaaaacggttaaacccggaaaaccggtttaacccggtttacggggttaaccgggtaccggttttaacccgggaacccttaaaccccgggttacgtttaccgggtttacccggttttacccgttttaaccccgg

SEQ ID NO: 213161 - DNA, 690 bp, Homo sapiens
  misc_feature: GYAE6OF02JI1ZB.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatacaaactacagcagtctggtccaggtactggtgacggccctcgcacgtaccctttcacctcacctgtcgactagtccgtaccggggaaatcggtcgctggacaacaagtggttagtagttaggtagttaggcgacgtcccggttcgaggtacggccttggtaggtcggtacgttagggtaaacggtacttattacgtacgtacccgtacggtaggtactaaggtaacgtaactacgtagacgtaagtacgttacgtagttcggacggtaccggttaccgtcgtacctaccgactacccgaaccccgtacgaacgtaacccgtacgaaacgtaactccggtaccgttcccgtaccctcccgtaaaccgttacgtacgttcgtacgtcctaaccgtcccgaaccgtacaacggtcgttaattttcgttacgtagtacgaagtacgactacgtaacgtacgttcggtacgtaccctaacgttccgttacgtccgtacggtacgggtaccgtaggttacg

SEQ ID NO: 213162 - DNA, 809 bp, Homo sapiens
  misc_feature: GYAE6OF02JR36K.21.27.C05.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtggggtntcctgtacacagactacaaactacagcacgtctcggtccaggtactgggtgacggtccctcggacacgtaccctttcactacaccgtgtcgacctagtaccggtaccggggtaaaattgtccggcgttcgggaccaaacgtaagttcgggttaggtaaagttcggaagtttacgggactaaccggttcccccggttacggacggaacggtacccgttggaaggttcggtacgtttagggaacgtacccgttagtttacgtacccgtccgtaggttaggtacgtacgaacgtaacttacgtcgtaacgtagtacttcgttacggtaggtacggtccgggttacgtacctaccgaaccttccgtaccgaaccccggtacgaaccgtaaccggtactaaacggtactaccggaccgttaccctacccttacccgtaaaccttaacggtcgttaccgtaccgtttacccaacccgttacccggacccgtaacgtaccccggtagttttacgtttttaaccgtttggttaacgaccggtaagggttaaccgcttaccgtaaccgtttacggttaccggttaccgttaacccgtacctttaacccggtgttaccccggtaccggtacggggtacccgttaggttttaaccccggg

SEQ ID NO: 213163 - DNA, 616 bp, Homo sapiens
  misc_feature: GYAE6OF02FN2F5.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttccttaccgtgctgggcctcccatggggtgtcctgtcacagatcaaactacagcagtctggtccaggactggtgaggccctcgcagaccctttcactcacctgtgacatcgtaccgggaaaatgtcgctggcaactaagtggttaggaattggattaggcagtccccggtgacgaggccttgagtggcgttaggaagacctattataccgtccgagtggtatgaagctagtcgacagacttcgtgtgtagtcggtcgtctcacctactaccacccgagaccgacctaccgaaagtaactacgacggtccctaccctcctaacctatcgtctctacctaccgtacccgacacgaccgtactacgttttacttttgacgttacgtaacgtacggtactctaacgtacgtttcggtaacgtaacccttacctttaccgtacgttaccgttcccggtacggggacccgttacggggttaccgtttaccgg

SEQ ID NO: 213164 - DNA, 685 bp, Homo sapiens
  misc_feature: GYAE6OF02G2UAH.21.27.C05.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtctgtcacagatcaaactacagcagtctggtccaggactggtgacggccctgcacgtaccctttcactcacctgtgacatccgtacgggaaatgtcgctggacacaagtggttagaatgataggctacgtcccgtgagcgtctgagtgctggaagtacctattacacgtccagtgctaagngaagtactaagtcgactagtactttacgtgtacggaacggtccggtttacgtacgttaccgaacctaccgtaaccccgaacccccgtaacggtaaacccgtaccgtacccgaaaaggtaacctacgtaaccggtttccctaccccgttaacccaaccgttaacgttacgttcgtaccgttacctaaccccgtacccggtaccgaacccgaccgttacgtttaagttttttacgtttacgacgtacgtaacggtggttaaccgtcctaaacgtacgtttacggtacgtaacccttacccttacgtttaccgtaccgtacgggttaccggggacgttaacccgggg

SEQ ID NO: 213165 - DNA, 776 bp, Homo sapiens
  misc_feature: GYAE6OF02G545L.21.27.C05.1.454.CMB.1.raw
  modified_base (494)..(494): a, c, t, g, unknown or other
  misc_feature (494)..(494): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgccgtgctgggcctccagtggggtcgtcctgtcacagatacaaactacagcagtctggtccaggtactggtgacggcctcgacacgtaccctttcacctaccaccgttgtacgaaccgtacgttaccggtaaccgggggtaaaattcggtccggcgttacgggaaccaaacgtaaggttcgggtttaaggtaagtttacggtaaggtttacggaccgtaacccggttccccggtaggaacggtacgggtccgttaggtaggtcgggtacggttaacgggaaacggtacccttaagttaaccgtaccggtacccgtaaggttggtaactaggaaacgtactagtacgacgtagtacttacgngtacggacggtccggtctaccgtaccgtaccgtacctacctacccgaacgtaccgtaccgtaacgaaacgtaacgtacgtacgtaccgtacccgtaccgtaacctaacgttcgttacgtcgtaccgtacccgtaccgtaaccgtacgtaccggttacgttacgttttacgtttacgtacgtacgtacggtacggtatacccccccgtaagttacgttacgtacgtaaccgttaccgttaccgttacgtaccgttaccggtacggtacggtacggttaaccgg

SEQ ID NO: 213166 - DNA, 638 bp, Homo sapiens
  misc_feature: GYAE6OF02HN9HX.21.27.C05.1.454.CMB.1.raw
  modified_base (399)..(399): a, c, t, g, unknown or other
  misc_feature (399)..(399): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtgggggtgtcctgtcacagatacaaactacagcagtctggtccaggactgggtgacggccctcgcacgtacccctttcacctccaccgtgtacgactatccggtaccggggaaaatgtcgcgtaggcaacaatggttaggtaagttggattaggcacgtccccggtacgagtaggccgttgtagtggtcgttggaaggactattactacgtccgagtggtatggaagtactagtcgacagtattntgtgacggtcggtcgtctcaccactaccacccgacgacgaccgtaccaaagtaactcgtacgtccttccctacccaccttaactcgtcctacgtacctaccgtaccccgacgtaccgaccggtacttacgttttagttttcgtacgtacgtaaggtacggtactacgtactacgttcggtacgtaccgttacccttcttaccgtaccgtccggtacgggtaccggtaggttaacccggg

SEQ ID NO: 213167 - DNA, 658 bp, Homo sapiens
  misc_feature: GYAE6OF02HAFUJ.21.27.C05.1.454.CMB.1.raw
  modified_base (317)..(317): a, c, t, g, unknown or other
  misc_feature (317)..(317): n is a, c, g, or t
  modified_base (372)..(372): a, c, t, g, unknown or other
  misc_feature (372)..(372): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctcccagtggggtcgtcctgtcacagatacaaactacagcagtctggtccaggtactggtgacggcccctgccgacgtaccctttcactcacctgtcgactagtacgtaccgggaaaatgtcgcgtgacaacgaagttggtagagttgagttaggcacgtcccgtgagnggtcctgagtgcgtaggaagtactatactaccgtccagtgtatagaacgtactangacgatacttctgtggtagcggttactcgttcaacctactaccgaaccccaagtaaccacgtaccgaaatacgtacgtacgtcctaccctacctacctagtcgtccgtcgtacctacctacccggaacgtacccgacggttaccttaggtttttacgtttacgtacgtaacgaacggttacggtaacgttacgtaacgttaacggttaccggttacctaacccgttaacccgttcgtttaccgaccggttccgggtacggggttacccggtaagggtttaacccgg

SEQ ID NO: 213168 - DNA, 745 bp, Homo sapiens
  misc_feature: GYAE6OF02HTFWV.21.27.C05.1.454.CMB.1.raw
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (252)..(252): a, c, t, g, unknown or other
  misc_feature (252)..(252): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtntctccgaggggggacncgccaccctctcctgcacncgccagtcagtctatcgctgacttggtacnccgtggtacagacaagaaactcgtggccgacggtcctccccgaaggtcctcctctacgttttaccgtgacactaccgaccgacgggccaacggttcggtaccgtacccgaagtacgtacggttacgagggttcgggacgggttgggtaacgttttaggggacttacggttaacgtttttccgtactaccctacccgtataccgacggtccccgtacccgttaacgaacggagtagggtaaacgtagttggtttacggtacgttagtttttacgtttcgttaccgtccgaacgtacttaaactttaattaaacgtttaccggtcggtacccgtttaggtcccgtttacggtaaccgggtttaccggaacccgtaaaccggggtaacctaaggggtaacggtaaaaccgtaaccggtaaaaaccggtacgttacggggttcgtaccggttaacgacccgtaaccgttacctttaccgttccgttacgttaacccg

SEQ ID NO: 213169 - DNA, 682 bp, Homo sapiens
  misc_feature: GYAE6OF02FY494.21.27.C05.1.454.CMB.1.raw
  modified_base (240)..(240): a, c, t, g, unknown or other
  misc_feature (240)..(240): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtgtcctgtcacagatcaaactacagcagtctggtccaggtactggtcgacggccctcgcacgaccctttcactcacctgtnacatcgtaccggggaaattggtaccgctggctaacgtaatggttaggaattggattaggcacgttccccgtgaggagtccttggacgtggcttagggaaggaccttagttactaccgtcccgagttggtatggaanactatgacagtcttacgtggtacggtacgcggttcgtccgtcaccgtactcctaaccccacgtaccgtacctaccgtaaccgaataccgtaccggtaccgtaccccttaccgtacccttaaacgttacgtactccggttactccccgtaccggtacctaaccgtaccgtacgtttacgttttaacgttttacggtttcgtacgtaaggtacggacgttacgtaccttaacgttaccggtacgttaaccgttacccttaccgttccgttaccgttcggttaccggggccgttaacgggttaaccggg

SEQ ID NO: 213170 - DNA, 851 bp, Homo sapiens
  misc_feature: GYAE6OF02JBQPO.21.27.C05.1.454.CMB.1.raw
  modified_base (203)..(203): a, c, t, g, unknown or other
  misc_feature (203)..(203): n is a, c, g, or t
  modified_base (328)..(328): a, c, t, g, unknown or other
  misc_feature (328)..(328): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccacgttggagtgattgtgatgacgcagtctccagccacctgtctgtgtctccgaggggganccgccaccctctcctgcacacgccagtcagtctagtcgctgtacgtgttacgccgtggtaccagacaggtaaacttcgtacggcctaggcctacccgaggtccttacccgtagtaacttttccgngtaccgaacttcccaccggaacgggtccctacggtcggttacgacccgaaggtaccgtaacgggtttcaacgggttcggggtccggttagggtaacgttttaacggggccgtaaaaggttttccggtttttaccgaccgttacccctaccggttaaacttccggtaaaccggtccccgttaaccccgtaacgttaaacgggtacggttaacgaaaccggtaagttacggttaacgtacgtttaaacggttttaacgtttccgtaacggtacctaaagaccgtttaaacgttaaacgtttaaacggttttccgtaaccggggtcctttaacgggtacccgttaacccgggtccgggttttaacccggaaccgttaaaccgggtaacccggttaagggtaaccggtaaaacggttacccggtaaaaccgttaaccggtttacggggtaaccggtaccggtttaaccggtacccggtaaccccgttaaaggtttccccggttttaacggttacctttaaccccggg

SEQ ID NO: 213171 - DNA, 811 bp, Homo sapiens
  misc_feature: GYAE6OF02FNXWI.21.27.C05.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (318)..(318): a, c, t, g, unknown or other
  misc_feature (318)..(318): n is a, c, g, or t
  modified_base (469)..(469): a, c, t, g, unknown or other
  misc_feature (469)..(469): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggancgccacctctccngcacagtccagtcagtctaatcgctgactggttacncctggtaccagcaagtaaatccgtggaccaggtcctcccgaaggtctcccgttcaacgttttcccggngtaccacgttaccccgaccgtaacggggtccctaacggttcgggaccgttacccgaaggtaccgtagggtttaccgaacggggttcggggtaccggtttaggggtaacttttcggggggaaacccttaagggtttaaccggtttttttccncggtttaacccgaacccgggttaacttccgtaacgggcccggtaaccccgtaaacgtaacggtaacgggtttagtaaaccgggtagtttacggtttacgaacgtttaacggtttttaactttacggtacctaaccggtaacgtactaaaccgttacggtttaaactttaccggtcgggtacccgtttaaggtcccggtttaacggtacccggtttccgggaccgttaacccggggtacgtaaagggttcggtaaaacgttccgaaaaaccggttacgttcgggtaacggttaccgtacggttacccgtaccgttacgttaccggtcgttttacccgtaaccg

SEQ ID NO: 213172 - DNA, 749 bp, Homo sapiens
  misc_feature: GYAE6OF02GH0GB.21.27.C05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (378)..(378): a, c, t, g, unknown or other
  misc_feature (378)..(378): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgaggggggancgccaccctntcctgcacagccagtcagtctatcgctgactggttagcctggtaccagcagaaatctggccaggctcccaggctcctcatttaccgngcactccaaccgngggcccacgtggtcgtcccagacaggttcaggtggcggtggatttggggactaggtagtttttccncttcgaacctattcgacggtcccgtacccttaacgaggtacgtaggaaacgtattgggttacgtaccgttaaggttttttaacttttccgttacggtacccgtaaggtaccttaaaagtttaaaccgtttaaacttttaaccggttccgggtacccctttacgggttaccccggtttacgggttaaacccgggttttccggggaacccggttaaacccggggggtaaacccggttaagggggttaaccgggtaaaaaccggtttaacccggaaaaaccgggtttaaaccgttcgggggttaaccggttaaccgtaccgggttacccgtaaacccggttacgtttacccgttacggtttccctttaacccgg

SEQ ID NO: 213173 - DNA, 709 bp, Homo sapiens
  misc_feature: GYAE6OF02F6VFX.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatcgtggccaggcctcccgaggcctccctctacgtttaccgtgaccactcccaccgagggcccaacgtcggtcgtaccccagaccgtaggttccagggtcgggtacgggttggtaagttttgggggaacctaggttacgtttttcgtccttaccgacccgtaatccgacgtcccggtacccctaacgacgaggtagaaggtattcggtttacgtacgttagtttttactttccgtgtaccgtaagtacctaaagttaattaaacgttacgttacgggtaccgttcggtaccggttaccgttaaccggttcccgggtacccggaaccggggtaacccgtaaggggttacgggtaaaacgttaacccggaaaaccggttaaccggttacggttacggtaccgttacggaccctaaccgtactttccggttacgttcctttaaccg

SEQ ID NO: 213174 - DNA, 715 bp, Homo sapiens
  misc_feature: GYAE6OF02H3IK2.21.27.C05.1.454.CMB.1.raw
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctaccagacaccactggatgattgtgatgacgcagtctccagccacccgtgtctgtcgtcctcggagggggcncgacccaccctctcctgccacagccagtcagtctatccgntagactgtacgcgtcgtacgagcagtaactcgtggaccgacggtcctcccgaggcccttcctccgttaatttaccgtgcctaaccttccccgaacggaccgggtaccctacgttcgggtacttacccgaacgtactaccgggttccgagggttgggaccggtgggttaagtttcggggaactagggttaccgttttctaccgttaccgaacgtactcggaccgtccgtacccctagagtacgtagtaatagtggttacgtatttaagtttctttacgctacgagtacctaattacgttaataccggtcgtaccgttacggtaccgttccgttaccggttacggacccgtaaacggggtaacctaaggggtaaccaacgttaacccgaaaccggttaaccgtagggtaccggtacccgttaggaacccttaaccccggttaatcccggtttaccgttcgtttaacccccgg

SEQ ID NO: 213175 - DNA, 851 bp, Homo sapiens
  misc_feature: GYAE6OF02F650H.21.27.C05.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccggagggggganccgcccacccgtctcctacgaccacgacgccagtcaggtctactcgtctgacgttggttacgccttcgggtaaccaggacaagtaaactcgtcggaccacggtccncccgtaggtccctacccgttacgttaacgtttaccggcgtacctactaccccgaacggacgggtccctaaccggttgggttacccgtacccgaagggtaaccgttacggttacgtaacggggttcggggtacccggggtaaggggtttacggtttaacgggggaaaccttaaggggtttaaccgggttttttttcccacccgttaccgtaaacccgttacgttacccggtacggcccccgttaacccgtaaacgtaacggtacgggttaagtaaacggtaggtttcggttaaccgagttttaacgttttacgttccgtaccggtacctaagttaaccgtaaattttaaaccgttaagtttaccgtacgggtccgtacgggttccgttaacccgggttacggtaacccgggaccgtaaaccggggtaacggtaacgggtaacggtaaaaccgttaaccggaaaaccgttacgggttacgggaccggttacgttacgggaaccctttaccgtagttaccggtttaccggttaccctttaaccgg

SEQ ID NO: 213176 - DNA, 728 bp, Homo sapiens
  misc_feature: GYAE6OF02G22CU.21.27.C05.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggancgcccaccctctcctgcacacgccagtcagtctatcgctgacttggttacgccgtggtaccagacaagaatcgtcggaccacggcctcccgacggtcctaccgtactacgtttaccgtgacctactcccacgacgggaccctacgtcgggtcctaccccgaagaccgtacggttacgagggttcgggtacgggttagggtaacggtttaggggactaggttacgtttttccacttccgaacctatccgacgtcccgtaccctaacgaaggtagtagaaagtacgttaggttacgtacgttaagttttacgtttccgtacgtacctagtaacctaaattaacgttaacgtttaaccgtcgggtaccgttaggtacccgggttacgttaccgggttacccggaaccggtaaccggggtaaccgtacggggtaacggtaaaaccgtaacggtaaaaccggtaacgtacgggtacggtaccgtacggtaccctaaccgttacgttacgttacgtttaccgttaacccg

SEQ ID NO: 213177 - DNA, 874 bp, Homo sapiens
  misc_feature: GYAE6OF02IQC1N.21.27.C05.1.454.CMB.1.raw
  modified_base (204)..(204): a, c, t, g, unknown or other
  misc_feature (204)..(204): n is a, c, g, or t
  modified_base (259)..(259): a, c, t, g, unknown or other
  misc_feature (259)..(259): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctttctctggctcccagacaccactggagtgattgtgatgacgcagtctccagccaccctgtctgtctcgtccgaggggganccgccaccctctcctgccacacgccagtcacgttcactcgctcgtacgtggttanccgtacgtaccgacgacaagaactcgtcgaccgtcggaccctcccgaggtcccttcccttaccgttacgtttacccggtgtacctaccgtacccgaaccggaccgggaccctacggttcggtccgtcccgaaggaccgttacggttacgacggggttcggtccggggttaggttaccggtttagggggaacctagggtttaccgtttttaccgtaccgttacgaaccctacggttaccgaccggtccccgtaaccccgttaacgagggtaacggttaggtaaacgttacggtttacggtttacccggtaacgtttttacggttttttaactttaccgggttaccggtaccgttaaaccggttaacgtttaaatttaaacgggtttaaaccttttaacccgggttccggtaccggtttaccggttacccgggttacccgtttaaccgggttaccccgggtaaacccgggacccggggttaaaccggtagggttaaacccgggaaacgtttaaaacccggtaaaccgggttaaccggtttacgggtaacggttaacccgtaccggtaacccgtaccggttaacgttcccggttttaaccgtaccgttttaaccccgg

SEQ ID NO: 213178 - DNA, 749 bp, Homo sapiens
  misc_feature: GYAE6OF02G5B9A.21.27.C05.1.454.CMB.1.raw
  modified_base (210)..(210): a, c, t, g, unknown or other
  misc_feature (210)..(210): n is a, c, g, or t
  modified_base (734)..(734): a, c, t, g, unknown or other
  misc_feature (734)..(734): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccacgtggagtgattgtgatgacgcagtctccagcccaccctgtctgtgtccgtccggaggggggacnccgacccacccttctctgccacgtacgcctagtcacgtctactcgctagacgttggttacgtcgtcggtaccagacgtaagaaactcgtcggaccgtacggccctaccgacggtcctccctacttacgtttaccgtcgactaacctccgaaccgtcggtaaccctcggttcggtccgtacccagtacgtacgttacgacgggtcgggtacggtcgggtagttacggggacgtagtttaccgttttactaccgtaccgtaacctacgtacccggaacgtaccccgtcccgtaaacggtacgttaaccgggtaaggtaggttaacgttcgggttacgttaacgttttacggtttaccttttccgacgtcccggtaattaacgtaacttaaagtttaccgtacggttacgtccgtacggtaccggtcggttaaccgggtacctaccgggtaaccggacggtaacgggtaacgtaaccgtaacgaaaccgtacggttggaccgttcaacggtcctaacgttaccggtnttccgtattaccccg

SEQ ID NO: 213179 - DNA, 594 bp, Homo sapiens
  misc_feature: GYAE6OF02JO7SL.21.27.C05.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcctccagggggganccgccacctctcctgacacagccatcagtctacncgntgactgtgctggccagcagatcnggcaggctccaggctaccnctatttccgacnctaccacgacggacctcgtcggtctacccgagaccgtggttcnggtcggcggtaggtacgttcgggacttagttcgtttccnctaccacactcgacgccgtaccgtagagtagtagagagttgtacgtacgttacgtttcttcgtacgtccgatacctaatactttaacgtacgttccgggtcgttcggtacggttaccggttaccggttaccggccggtaaccgggtaccgtagggtaacgacggtaacgaacgtacgtggtacgtacgtacgccgtaccgtcgtaccgttcgtcgtac

SEQ ID NO: 213180 - DNA, 576 bp, Homo sapiens
  misc_feature: GYAE6OF02GHYQY.21.27.C05.1.454.CMB.1.raw
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactcagcagtctggtccaggactggtagaggccctcgcagaccctttcactcacctgtcgacatctaccggggaaaatgtcgctggcaacaagtggtgaattggataggcagtcccgtgagngcttgagtgctggaggctatacgtacgtccagtggtatgaatactaatgcaagtnttcgtgtgngcggtcgctcgactatccacccagacaccgtcaaacgtaactcaggtcctaccctccacctaatcgtactcggtccaaccgtccgacgaccacgtccttaagtttatttttcgacgtaccaaggtacggtactaccgtaactacggtttcgtacgtaccttacccgttacctttccggaacccttccggtacgggtaccacggggtttaaaccg

SEQ ID NO: 213181 - DNA, 786 bp, Homo sapiens
  misc_feature: GYAE6OF02FSV7M.21.27.C05.1.454.CMB.1.raw
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgccacagccagtcagtctatcgctgactggttacgcctggtaccagcaagtaaactcgtggccagggcctacccgaggtccctccgtactacgttttaacccggngtaccaacgttccccgaccgacgggccctacggttgggtccgtaccccgaaggtaacgtcggttacaggggttcgggcgggttaggtagttttacggggactacgggttacgtttttcctaccgtaccgtaacccgtagtccgtacggaccccggtaccccttaacgaacgggtaacgttaggaaacggttacttcgggtttacgtaccgtttaaggtttttacgtttccgttaccggtaacccgtaacgtaccttaaaagtttaacgtttaaacgtttaaccggtccggttaccggttacgtcccgggtttaaccggtacccgggtttaccggaacccggtaaaccggggtaacccggtaaagggttaccggtaaaaccgttaacgaaaacccggttaacggttgggtaaccggtacttacggaacccttaacccggtctttaccgttacgttccttaaccgg

SEQ ID NO: 213182 - DNA, 649 bp, Homo sapiens
  misc_feature: GYAE6OF02GPNYC.21.27.C05.1.454.CMB.1.raw
  modified_base (205)..(205): a, c, t, g, unknown or other
  misc_feature (205)..(205): n is a, c, g, or t
  modified_base (407)..(407): a, c, t, g, unknown or other
  misc_feature (407)..(407): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtcctgtgtcctccgaggggggancgccaccctctcctgcacagccagtcagtctatcgctgacgttggttacgccgtcggtaccagcaagaaatcgtggccgaggctcccaggctccgtctactttaccgtgaccactcccgaccgacgggccacgtcgggtacgtcccagacgacggttcaggtacgggtcgggtggtagtttcgggactacggtacgttttcncttccgtacctacttccgacgccgtacccgtacgagtacggtacgaagtataggttcgacgttagtttactttcgtacgtacctagtacgtaattaacgttaattaccgtacggtcctacggtcggttaccggttaccggtaccggtaccgtaaccggggaccgtaacggggtaacgaaacggtaaccgaaacggtactacggtaggccgtcgacgtaccgtacgtacgttcgtcttacccg

SEQ ID NO: 213183 - DNA, 802 bp, Homo sapiens
  misc_feature: GYAE6OF02IJ2J2.21.27.C05.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccacgcccaccctgtctgtcgtccnccggagggggcnccgccctaccctctcctgccacacgtccaggttcagttcctatcgccgtagtaccgttggggtacgtccgttcggtaacccaggacctaaagaaacttccggtcggccctacgggtacctccccgacgggtcccttacccgtacgttaccgtttaccccggtgtaccctaccgtaccccgtaaccgggaccggtcccgtacggttcgggtacccgttcccgaacggaccgttacgggttacgacgggtggggttaccggttgggtacggtttagggggaacttacgggtttcgttttaaccctccaacccgttaccgtaacgttcccaaccgggtccctaacccgtacgtaacgggtaagtaaggaacggtttaggttcggttagttacgtttaacgtttttaacgtttaccgttccggtaaccctaagtacgtttaaataacgtttaaacgtttccggtaccgtacgtttcgggacttccgggttaaccgttaccgggaccgtaaccggaacgggtaagtaaccggtaaacgtaacggtaaacgtacggtggtagccgtacgtacctaccgttatccgttacgtaccttacccg

SEQ ID NO: 213184 - DNA, 687 bp, Homo sapiens
  misc_feature: GYAE6OF02IYKK5.21.27.C05.1.454.CMB.1.raw
  modified_base (165)..(165): a, c, t, g, unknown or other
  misc_feature (165)..(165): n is a, c, g, or t
  modified_base (214)..(214): a, c, t, g, unknown or other
  misc_feature (214)..(214): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (373)..(373): a, c, t, g, unknown or other
  misc_feature (373)..(373): n is a, c, g, or t
  modified_base (542)..(542): a, c, t, g, unknown or other
  misc_feature (542)..(542): n is a, c, g, or t
  modified_base (658)..(658): a, c, t, g, unknown or other
  misc_feature (658)..(658): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgnagtctccgacgcccaccctgtcctgtcggttccaccgggaggggggacnccgccctacccttctcctcgacacacgccctagtctacgtctagtccngtacgtacgttgggttacnccgttacggtacctagacgaaacgtaacgtcgtacggccgtaacggtccctacccggaacggtcccttaccgttacgtttaacgttacccgnggtacctaccgtacccgaccgtacgggaccctacgtcggtcctaccgaacgacgtacggtcgtacggtcgggtacggtaggtacggttacgggatacgtttacgtttccacacgtacgtctacgacggtcccaccgtaacgaggtagtacgtaacgtacgttgtacgtntttacgtttctcgacgaccgtaagtactaaagttacgttaacttcggcgtagtccgtaccgtcgtaacgtcgacggtacgtaacgagtacgaaacgtcgaagtacgtggtacgtanacgaccgattacgtctacggtctaaccgg

SEQ ID NO: 213185 - DNA, 881 bp, Homo sapiens
  misc_feature: GYAE6OF02GTAKM.21.27.C05.1.454.CMB.1.raw
  modified_base (164)..(164): a, c, t, g, unknown or other
  misc_feature (164)..(164): n is a, c, g, or t
  modified_base (204)..(204): a, c, t, g, unknown or other
  misc_feature (204)..(204): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacncagtctccagccaccctgtctgtcgtctccgagggggganccgccaccctctcctgcacagccagtcagtctatccgctggtacgtggttacgccgtaggtaacccagaccaaggtaaacttcgtacgggtacccacgggccctaccccgaggtcccttacccgtaccttaaccgttttacccggtcgacctaaccttccccgaaccccggtacgggtacccctaaccggtttcggggttcccggtaccccggaaacgtaccggttaacgggtttccgtaacgggggttcgggtaccggggtacggtttaacgggttacgggtaaccgtttacggttttaaccggttttccttacccgtaccgaacccgttacgaccggtaacccggtccccgtaacccttaacggtaacggtaacgggttaacggtaaacggttagtttcgggttacggttacgttttaaacggtttttaccgttaccggtacctaaccggttaaccgtaacttaaacggtttaactttaaccgggttaacgtttcccggggcccgttaaccgggtttaccggttacccggggttaccggttaaccccggggaaccgttaaccgggggaaccggtaagggtaacgtaaaccgtaacccgggtaaaccgttggttacccgggtacgtccggtaacccacggttaacccgttactttcgttaccgttacttaacccgg

SEQ ID NO: 213186 - DNA, 847 bp, Homo sapiens
  misc_feature: GYAE6OF02I2UKN.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcctccgaggggggcnccgcccgacccttcgtcctggccacgacgccgagtcagtctactcgctgtaccgtggttacgccgtggtaaccaggaccaaggtaaacgttcgtacgggaccgtaacgggccctacccgacggtcctaccgttactaacgtttaccgtgacctaccgttcccaccggacgggccctaacgttcgggtccgtacccgaagtaccggtacggttacgagggttcgggaccgggtttagggtacgttttaggggacgtaaggtttacgttttcgtaccttacctaacgtacgtaccgtacgtaccccggtaccccgtaacgaacgtaagggttaacggaaacggtaacgtttcgggtttacgtaaccggttttaaggtttttaacgttttacccgtacggttaaccccgttaagtaacccgttaaaacggtttaatttaaaccggtttaaccgtttacccgggtttacgttccggttaacccgggttttacgggttaaccccgggttcccgggtaacccggggtaaacccgggtaaccgggttaaccgggtaaaggtaaacccgttaacggtaaaaacccggttacggtacgggtaacggtaccgttacgaccttacgtaaccgttcggttcgtttaccgttacccg

SEQ ID NO: 213187 - DNA, 739 bp, Homo sapiens
  misc_feature: GYAE6OF02IU6IQ.21.27.C05.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctccagcccacctgtctgtcgtctccgagggggganccgccaccctctcctgacacacgccacgtcgacgtcttacncgccgtagacgttggttacgcctacggtaccacgacaagaaactcgtcggaccaggtcctacccgaggtcctacctcgtacgtttacgcgtacnctacccacgacggccacgttcggccgtaccgagaccgtacggttcgaggtcgggtacgggtaggttacgggttcgggtaacgtaggttacttttcgtaccttaccgactaacgtccgtaccgccgtaccctaagtaacgtacggttaggaaaacggtcgttaggttcgtactttaaggttttctttaccgtgtacctaacgtactaattaacgttaaacttcggttacgaccgtttcggtacgtaccgggtttaaccggtaccgggaaccggtaaacccggggtaaccggtaaacgggttaacggttaaacccgtaagggtaaaacccgttacgggtacgggttaccggtacgaccgtaaccgtacccgttaggttaccgtttaccgttaccgtttacccg

SEQ ID NO: 213188 - DNA, 854 bp, Homo sapiens
  misc_feature: GYAE6OF02HCWAT.21.27.C05.1.454.CMB.1.raw
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtcctccggagggggacgcgcccaccctctccgtgcacgagccagtcagtctatccgctcgtacgtggttacgccgttaggtaaccgagacgaaagtaaaacgtcgtacggcccgacggtccctaccccgacggtccttacccttaccgttaaacgtttacccgtcgaccgtaaccttaccccgaaccggaccgggacccctaaggtttccgggttaccccggttacccgaacggtaaccgtcgggtttaacgtaggggttcggggtccgggtttagggtacggtttacgggaacgttacggtttagttttcctaccgttaaccgtaacctacgttaccgaccggtcccgtaccccgtaaagacggtagttaacggaaagtggtttcgtttaacgtagtttaacggtttttatttccgttaccggaacgttacgtaaaccgtttaaatttaaaacgttaacgtttaaccggtacggttacccgttacgggtaacccgtttaccgggtaaccgggtttaccgggaaacccggaacccgggttaaaccggtaacgggttaaaccggtaaaaccgttaaacccggtaaaaccggtaccggttaacgggtccggttaccgtacggtaccccgtaaaccgttacgtttacgttaaccgttccctttaacccgg

SEQ ID NO: 213189 - DNA, 569 bp, Homo sapiens
  misc_feature: GYAE6OF02JJBSQ.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgacgccctcgcagaccctttcactcacctgtgacatctaccggggaaaatgtcgctggcaacaatggttggaattggattaggcagtccccgtgagaggaccttgagtggcttaggaaggacctattactacgtcccagtcggtatgaagactatgcagtattctgtgagcggtcgtctacacatccacccagaccacgtccaagtaactcaggtacctcctaccacctaatcgtctcgtcacctcccgacgaccacgtacttagtttacttttgcgtacgaacgtaggtacgtactacgtagtttcggtacgtacttaccctacgttcgtaccgttaccgtcggggtacctaagggttaacccgg

SEQ ID NO: 213190 - DNA, 617 bp, Homo sapiens
  misc_feature: GYAE6OF02IG9LM.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctcccatggggtgtcctgtcacagatcaaactacagccagtctggtccaggactggtgaggccctcgcagaccctttcactcacctgtcgacatcgtaccggggaaaatcgtcgcgtggacaactaagtggttaggtaattggattaggcaacgtccccgtacgaggacggtccttgagtgcgtaggaagtacctatatacgtccagtggtatgaacgtactatgactagtatcgtgtgagcgtacgtctacacataccgaccctagactacgtaccaaagactacaggtctcccgtacctaccaagttctcgtacgtccaaccctaccggaaccgtaacgaccggtactttacgttttaacttttaggtacgtaccaagggacgggtaatccggtaacctagttacggtaacgtacccttaaccgttcgttaccgaccgttcccggtagggtacccgtaaggttacgg

SEQ ID NO: 213191 - DNA, 675 bp, Homo sapiens
  misc_feature: GYAE6OF02F6OJ7.21.27.C05.1.454.CMB.1.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
  modified_base (465)..(465): a, c, t, g, unknown or other
  misc_feature (465)..(465): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggacgtgattgtgatgacgcagtctccagccaccctgtctgtgtctccgagggggacnccgccacctctcctgcactacgccagtcagtctatcgactgactgtacgccgtggtacctatcaagtaactcgtcgaccaggacctccgaggtcctacctcgtacgtttaccgngactaactcccgaacgtaccgggccacggttcggtccgtccgaacggtactacggtttacgacgggttcgggcggttagttacggttcgggactaggttacgttttcctccgtaccacccgtagtccaacggtcccgtcctaaacgnggtacgtagtacgtattcggtacgtactttacgtttacttcgacgtaccgtaacgtacttaattaaccgttaacgtacgtcgtactcggtaccgtccggttaaccgtcggaaccgaaccggtaacgtacgggtaacgtaaacgtaccggaaaacttcggtaacgttcgacgtaccgtacctaaccgtgtacccgtttctccgttaacccg

SEQ ID NO: 213192 - DNA, 726 bp, Homo sapiens
  misc_feature: GYAE6OF02IOKPU.21.27.C05.1.454.CMB.1.raw
  modified_base (204)..(204): a, c, t, g, unknown or other
  misc_feature (204)..(204): n is a, c, g, or t
  modified_base (256)..(256): a, c, t, g, unknown or other
  misc_feature (256)..(256): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtcgtctccgagggggganccgccaccctctcctgcactagcctagtcagttctatcgctagacttggttnccgtaggtaccagcaagaactcgtacggccaggcctcccgaggcccttcctactacgtttaccgtgacctacgtccccgaaccgaccgggtaccctacggttcggtccgttaccccgaagtaccgtacggttccgaagggttccggggtaccgggtttacgggttaacgttttacgggggaaccgttacgggtttaccgtttttccgtccgttaccgaaccttgttaccgacgtcccgtacccttaacgaaggtacgtaggaacgtagttcggttacgacgtttagtttacttcgactaccgtaatataagttattaaacgtcgtacggtcctcggtaccgtccgttaaccggtcgaaccgggtaaccgggtaaccgtagggttaacgtaaaccgtaaccggtaaacccggtagttacgggtacggtaccacgtaccctaaccgtagtttccgttaccgtccttaacccg

SEQ ID NO: 213193 - DNA, 756 bp, Homo sapiens
  misc_feature: GYAE6OF02FOKUP.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctgacctcccagacaccactggagtgattgtgatgacgcagtcctccagcccacctgtctgtgtcgtcgagggggacnccgccaccctctcctgaccacacgcctagtacagttctagtccgtcctacgtacgttggttacgtccgtacggtaccgtacgacgaacgaaagttccccccccgtaggccgacggcctacccgacgtccctccttaccgttacgtttaccgtcgacctaccgtcccgaaccgaccggtacccgtaccgtccggttaccgtacccgtaacgtaccggtacggttacggtaggtcgggtacggtagggttacggtttacgggaacgttaggtttaccgttttccgtacctaccgtacctacgtaccgtaccggtccgtacccgtacgaacggtacgtacgtaagtagttacggttcgtacgttagttttacgttccgttactaccgtaagtactaaagttacttaacgtacgttaccgtcgtacgtccgtacgttaccggttaccggaaccgtaacgggtaaccggtaaggtaaccgtaaacgtaacgtaaaccgtacgtacggttacgtaccgtaccgaccgttaccgtacgttcgttacgttaccttaccg

SEQ ID NO: 213194 - DNA, 737 bp, Homo sapiens
  misc_feature: GYAE6OF02HGIBO.21.27.C05.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgcgatcgaagggtttgggggaggaactgctcagttaggacccagacggagccatggaagccccagcgcagcttctacttcctcctgctttctctggcctcccagacaccactggagtgattgtgatgacgtcagtctccagccacctgtctgtgtcctcggagggggacnccgccctacctcctcctgccacgacgcctagtccagtacctacgtccgtacgtcgtaccgttcggttacgcccgttacggtaccagacgaacgtaactcgtcgaccgtaggccctcccgacggtccctccgttaccgttaacgttccggtcacctaccgtacccgaacccggtacggtaccctacggtccggtccgtacccgtacgtacgtacggttacgaggggtcgggtcgggtaggttacggtacggggtaactacgggtttacgttttcctctaccgtacctcgtccgaccgttcccggacctaaggtaggacggtaaggtaaatcgtttaggttcgtacgtttaagttttcttacgccgtaacctagtaaaccttaagtttaacttaacgtttcgtacggtccgtacgggtaccgttacgggttacccggtaccggaccgggtaaccggtaagggtacgaaaggtactaaaccgaacgtaggtacggtcgtagtccgacttacctaggttccttagttcctaccg

SEQ ID NO: 213195 - DNA, 771 bp, Homo sapiens
  misc_feature: GYAE6OF02H9V37.21.27.C05.1.454.CMB.1.raw
  modified_base (162)..(162): a, c, t, g, unknown or other
  misc_feature (162)..(162): n is a, c, g, or t
  modified_base (215)..(215): a, c, t, g, unknown or other
  misc_feature (215)..(215): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
tcagtcgtcgctcgcacgaccggtgctcgatttagacgcgatcgaagggtttgggggcagagcctgctgacttctggctgaccagggcagtccaccggagctccagacaatgtctgtctccttctcactcttcctgcccgtgctcggcctccagtcggggtntccgtgtcacagtatacaaaactacgagcacgtcgtcggtacccaaggtacgngggtacgacggccctacgactacgtaccctttcaactccactgtcgactacgtaccgtaacgggaaatcggtccgacgtcggaacaacgttaaggttgggttaggtaaagtttcgggaattacggtccgaccggttacccgaggaaacgtcggtaccgttgacggttcggtacgttaggaaacgtacttagtacgtccgttcgaaggttgtaacgngtaaacgtctagacgactaggtnttcgtaggtaacgtggaccggtttctacctactaaaccgactacccaaaacccggtagttaacccgaacggttaaccgaaaagggtctaccggtaacgtccccttaaaccccgtacgttaaacccaaacgggtttccgtacttaaccccggtacgttaacccccggtaaaccgtaccgaacgttaccggtacgttttacgttttaacgtttccgaacgttacgtaacggacggtcttaaccgtacgttgttaacggtaccgtaccttaaccgtcgtaacgtaccggttacggtacgggtacgttaaccggtttaacg

SEQ ID NO: 213196 - DNA, 699 bp, Homo sapiens
  misc_feature: GYAE6OF02FRT60.21.27.C05.1.454.CMB.1.raw
  modified_base (201)..(201): a, c, t, g, unknown or other
  misc_feature (201)..(201): n is a, c, g, or t
  modified_base (680)..(680): a, c, t, g, unknown or other
  misc_feature (680)..(680): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggncgccaccctctcctgcacacgccagtcagtctatcgctagtacgttggttacgcctaggtaccagacaagtaaactctacggaccgacggccctacccgaggtccttccctacttacgtttaccgtcgacctacgtcccaaccgtacgggccctacggtcggtccgtaccaagtacgttacggttacgagggttcgggacggttagggtacgtttacggggaacttaggtttacgttttcctaccgtacctaccgtacgtccgtaccgccgtacccttaagacggtaggttaacgaagtacgttcgtcgtactttagttttacgttcgtcgacctaagtacttaaagttaagttaacgttaccgtcgtaccgttggtccgtacggttaccggtaccggaacgtaaccggggaccgtagggtaacgtaaaccgtacgtaaaccggttcgtagggtacgtcctacggtaccctaaccggtnttccgttacgttcctaccg

SEQ ID NO: 213197 - DNA, 919 bp, Homo sapiens
  misc_feature: GYAE6OF02FGJDY.21.27.C05.1.454.CMB.1.raw
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgtgatgacgcagtctcagccacctgtctgtgtctccgaggggggaccgccacctctcctgcacacgccagtcagtctactcgcgtgacgttggttacgccgtacggtaccagcaagtaactcgtcggccgacggtccctacccgacggtcccttacccttacttaacgtttttacccggtcgtacctaaccgttaccccgaaacccgggtaacggggtacccctaaccgggtttcggggttacccggttaaccccggaaacgggtaaccggttacgggtttaccggtacgggggttcgggggtaccggggtttaggggtttaacgggtttttacggggggaaaccgttaacgggttttaccggtttttttacccgaacccgtttaacccgtaaacccgttacgttacccggtaaccgggtccccggtaaccccgttaacggtaacgggttaacgggttaacggtaaacggttacgtttacggttacggtacgttttaacggtttttacgtttaccgttacggtaccgtaacgtaacttaaaacgtttaaacgtttaaaccgtttaccggttaccgggtacccgtttacggtacccgggtttaccgggttacccggttacccgggaacccggtaacccggggtaacccggtaacggggttaaccggtaaaccggttaaaccggaaaaccggttaaccgtacgggttacggtaccgttacggtaacccgtaacccgttaacgttccgtttacgtttacccttaaccg

SEQ ID NO: 213198 - DNA, 777 bp, Homo sapiens
  misc_feature: GYAE6OF02IXVIE.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgcgtcgggccctccgagtcggggtctcctgtcacagactaccgaaactcagtcagtctggtaccaggactgggtcgacggtccctcggcacgtacccttcactcctaccgtgtacgactacgtaccggtaaccgggtaaatcggtcgcgtaggactaaacgtagtcggttaggtaacttgggtacttacggccgtaaccggttcccggtaggtaacggtaccggttaccgttaggaacggttcgggaccgtttaacgggaaaccggttaccttaaacgtttacgtaaccccggtacccgtaagggttaggttaaacgtacgggtaaaacgttacgttaacgtacggtacgtaacgttactttcggtacgtaggaccgttcggtacctacgtaccgactacgtacccgacccgtaacgtacctaaccggtaacgaaacgtaaccgtcgtacccggttaccctaccctaaccgtaaccgttacgttctaccgtaccgtacctaccgtaacccgacgtaaccgtacgttacgttaacgttttcgtacgtacgaacggtaagtacgacttaccgtaagtaccggtgtaacttccgtaccgtacgttcgtacccgtcggtaccgggtacgtaccggttaaccg

SEQ ID NO: 213199 - DNA, 598 bp, Homo sapiens
  misc_feature: GYAE6OF02FLKLC.21.27.C05.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcncagccagtcagtctatcgctgactggttagcctggtaccagcaagaaatctggccaggcctcccaggctcctcatttaccgngcactccaccagggcccacgtggtcgtcccagactcggttcagtggcgggtggtagtttgggacaggtacgttttctcgtacctacctatcgacgtcgtccctaanacgaggtagaagtattcggttgacgttagttttaattcgttagacctagtacaattattaacttacgtcgtctaggcgttacgaccgttcggacgaccggtaaccgtaggtacgaaacgttaccgaaaccggtaacgttaggtcggtacgttacgaccctaaccgtacgttaccgttacgttcttaaccg

SEQ ID NO: 213200 - DNA, 551 bp, Homo sapiens
  misc_feature: GYAE6OF02FGL6L.21.27.C05.1.454.CMB.1.raw
  modified_base (156)..(156): a, c, t, g, unknown or other
  misc_feature (156)..(156): n is a, c, g, or t
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
  modified_base (400)..(400): a, c, t, g, unknown or other
  misc_feature (400)..(400): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggatgattgngatgacgcagtctccagccaccctgtctgtgtctccaggggggncgccacctctcctgcacagcccagtcagtctatcgctgactggttancctggtaccagcagaaatctggccaggcctcccaggcctcctcactttaccgtgcactccaccgagggcccacgtggtcgtcccagcacggttcaggtggcggttggagtttgggactaggtacgtttcgtctcaccatcacgcgacccgtanagagtagaagtatggtgctagtttattcgtcgacctagactaagttattaattacgtgtaccgttgcgttcgtacgtcggccgacgggacctaggtacggaagtaccgaacgtacgtggtcgacgtgacctaccgtagtctacgtcttacg

SEQ ID NO: 213201 - DNA, 803 bp, Homo sapiens
  misc_feature: GYAE6OF02G4JRR.21.27.C05.1.454.CMB.1.raw
  modified_base (205)..(205): a, c, t, g, unknown or other
  misc_feature (205)..(205): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctttctctggcctcccagacaccactggagtgattgtgatgacgcagtctccagccaccctgtctgtgtcctccggagggggnccgcccacctctccgtgcacacgccagtcagtctacgtcgactgacgttggtactcccgttagaccnganaacgtaancgtcgccgaggtcctaccgacggccttcctactacgtttaccgngcctacgtacccgaccggtacggtccctagttccggtcgtaccccaaggtacgtaacggttcgaacggggtcgggtacggttgggttaaccgttgggaaccgtttaaggtttcgttttttcccgaccgttaaccctaaaccgtcgtacccgtaaccggtcccgtaaccccgtttaaggaacggtaacgggttaacggtaaaagttcgtttacggttacggtttaaaccgtttagtttttaaccgttcggtaaccgtaccggaaacgttaccgttaaaacgttttaacgtttaacgtaccggttccggtaccgtttaccgggtaccgggtttaccgggtaccgggttaacccggaccgggttaaaccgggaaacgggttacggttaaggtaaacccgtaacggaaaaccggttacggtcggttaaccggcttacccgaccgttaaccgtggtttcccttacggttacccttacccgg

SEQ ID NO: 213202 - DNA, 768 bp, Homo sapiens
  misc_feature: GYAE6OF02G5F16.21.27.C05.1.454.CMB.1.raw
  modified_base (161)..(161): a, c, t, g, unknown or other
  misc_feature (161)..(161): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttctgcccgtgccgtggccctccagtggggtntcctgtcacagactacaaactcagcagtcgtggtaccaggtactggtcgacggtccctcgactacgtaccctttaccacctcacctgtacgactacgtaccggtaaccggggtaaaagtcgtccggcgtacggaccaacgtaaggtcgggttaacggagttggtacgttacggaccgtaccggtaccccgttacggaacggaccgggtcccgttaggtcggtacgggtacgtacgggtaaacggtacccttaagttaccggtaaccgttccggtaggtacggttagtaaggtaacgtacttacggagtaccgtaggtacgtttcggtacggtgtacgggtccggttacgttaccgttaccgaacctacccgtaacccgtaaccccgtacggtaaccctaaccggtaacccgaaacgtaaccgtacggttaccggccccgttaaccccgtacccgttaaaccgtacgttcggttcctaccgttacccaccggtacccgaccgtaccgtaccggtacttacgttttacgttcgtacgtaacaggtacgactacgacgtacgtgtaccgtacttaccgtactccgtcgtccggccggtacgtaggtaccg

SEQ ID NO: 213203 - DNA, 720 bp, Homo sapiens
  misc_feature: GYAE6OF02I4N2G.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttctgcccgtgctgggcctcccatggggtgtcctgtcacagatcaaactacagcagttctggtccaggactggtcgacggcccctcgcacgtaccctttcacctcacctgtcgactacgtccgtaaccggggaaatcgtcgcgtcggacaacagttggttaggtaagttggtatggctacggtccccgtacggagacggtccgttggaggtcggacgttagggaacgtacctaagttactaccggtccgtaggttaggtactaggaactacgttagtcgtacgtagttacttcgtgtacggtacggtccggttccgttccgtaccctaccgtaccgtaccccgtaaccccgaagtacccgtaccgtaaccgaaacgtaacctcggtaccgtcccttacccaccgttacccgttaactcgttctacgtacccgacccgtacccgacgaccgttacgtacgtttagttttttacgttcgttagaaccgtagggtacggtactacctacggtttaccggttcgtacgttaacccttaccgttaccgttaccggtaccgttacccgggtacggggtaccggttagggttacccgg

SEQ ID NO: 213204 - DNA, 834 bp, Homo sapiens
  misc_feature: GYAE6OF02JUM8H.21.27.C05.1.454.CMB.1.raw
  modified_base (173)..(173): a, c, t, g, unknown or other
  misc_feature (173)..(173): n is a, c, g, or t
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagtcgtcgctcgcacgaccggtgctcgatttagacgcgatcgaagggtttgggggaggaactgctcagttaggaccagacggagccatggaagccccagcgcagcttctcttcctcctgcttctctggctccagacaccactggagtgattgtgatgacgctagtctccanccaccctgtctgtgtctaccgagggggancgcccacctctccngccacacgccagcagnttacncgctgacgttgtacncgtgtcagcagaactctaggccgaggtcctccgaggtccctcctacgttaacgttaccgtcgactacctccgaacccggaggtaccccgtacgtgggtaccggtcccaaaggtaccgtacggttacgaacggtttggggaccggtttagggtaggttttccggggaacgtaaggtttaaccgtttttcgtaccccgttaccgaaccgtagttaaccggtacgtaacccggtccccgttaaaacgtagggtaccgggtaacgtaaacggttacgttcggggtttacggtacttttaacggggttttacttttaccgtaccgggttccgaaagttaccctttaaaattaaacgtttaaacgtttcccgtttacggttaccccggttagggggttacccctttaaaccgggttccgggggttaaccccggtaaccggggtaaaccgggaaacccgtttacgggggtaaacgttaaaaccggttaacccggtaaaaacggtaaccgttttccgggacggtttaaaccgttcgtaaacccggtaaccccgttaagtttaccccggttttaggttaccctttacccgg

SEQ ID NO: 213205 - DNA, 918 bp, Homo sapiens
  misc_feature: GYAE6OF02GLZS0.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatacaaactacagcagtctggtccaggactggtgacggccctcgcacgtacccgtttcacctccacctgtgactactcgtacggggaaaattcgtacgctggaccaacgaattcgggttaggtaacttgggatttacggactaccggttcccccgtaggaacggacggtaccgttcggaacggttgggtacgtttaggggaacggtacccttaagttttacgtaccggttccccgtaaggttcgggttaagttacggtaaacgtacgttaacgtcggtaactaaggtacttttacgtcggtaaggtacgggttccggttaccggttacgttacccgtaaaccctaccgttaacccgaaccccccgtaacggtaaacccgtacccggtaaccctaaaaacggaaccgtttaccggtaaccgggtttaccccttaccccctaccccgttaaacccgttaaacgtttcccggtttacttaccggttaccccgttaaacccgtacccccgggttaaccccgggaaccccggttaaccggggttaaccccttttaaggggttttttaacctttttttacgggaacccgttaacgggtaaacggggttacggggtaaccttacccggtaaactttaaccggtttccggggtaaccgttaaccccgtttaaccccgttaccggtttaaccgttaccccgggttacccgggtttaaccgggggtacccgggtttaaccggggttttaaaccccgg

SEQ ID NO: 213206 - DNA, 728 bp, Homo sapiens
  misc_feature: GYAE6OF02FTSXS.21.27.C05.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagacgcgatcgaagggtttgggggaggaactgctcagttaggacccagacggagccatggaagccccagcgcagcttctcttctcctgcttctcgtggctcccagactaccactggagtgtattgtgagtgacgcagtcctccgagccacctgtcgtgtgtcgtccgaggggancgccacctctcctgcacagccagtcacgttctagtccgcgtacgtacgttggtttacgccgttacgggttaaccacggctaacggtaaaactttccgtacgggacccgtagggcccccttacccggacggtcccgttacccgtaccgtaacgtttttaccggtagcgtaccgtacccgacccgtacggggtaccctacggttccggttaccggtcccgaaggtaaccgtacggttcgagggttcgggtcggttagggtagtttagggaactacggtcgtttttccgtaccgtactaccgtatcgaccgaccgtaccctagtacgtacgtagaaagtgttcggtacgtagtttagttttacgttacgtcgtacgtcgtacttaagttaagttaagttcgtacgtccgtggtccgttacgtccgttaccggaccgttacggacgttaacggtagaaccgttaacgaaccggttaacgtggttacgtacgtacgtactaacgttacgtcgttctaccgttaccg

SEQ ID NO: 213207 - DNA, 861 bp, Homo sapiens
  misc_feature: GYAE6OF02GLFBU.21.27.C05.1.454.CMB.1.raw
  modified_base (697)..(697): a, c, t, g, unknown or other
  misc_feature (697)..(697): n is a, c, g, or t
tcagtcgtcgctcgcacgaccggtgctcgatttagacgcgatcgaagggtttgggggcagagcctgctgacttctggctgaccagggcagtcaccgggagctccagacaatcgtctgtctccttcctcatccttcctgcccgtgctcgggcctccagttggggtctcctcgtacacagacttacaaacctacagtcacggtcgtaggtccaggtacctgggtcgacgccctggccgacggtaccctttgacccttacaccgttgtcgtacacgttccggtaccggggaaatcgttggtaccgcgtacgaaccaacgtaacgttgggtacgacgtttaggattacggccgttaccggttaccccggtaggaacggtaaccggttcccgttaggaacgggttcgtacggtttaacgggaacggtacccttaaggtttaaccgtaccgttaccggtaggtaggtttaaaccgtaggtaaaccgtaccgttaggttacgaccgtaaggttaacctttgtaacggttacgaaccgggtccggttagttacccgtaccgtaaaccgtaacgttaccccgaacccgtaacggtaacccgtaacccgtaagtaaaccggtaccttaccggtaccgtacccgttacctacccgtaacgttaacgcgttttaaccgccgttaaccgtaaccccggttacccggtaanaacccgggtaaccgggtttctttaaaaccggtttttccgttaggtaacccggtaagtaaccgttaaggggtacccttaccgtaaacggttcggtaccgtttaaccggtacctttacctcccggtaccggttaccttaccgggacggggtaacctttaaccgggg

SEQ ID NO: 213208 - DNA, 600 bp, Homo sapiens
  misc_feature: GYAE6OF02HJMUE.21.27.C05.1.454.CMB.1.raw
  modified_base (398)..(398): a, c, t, g, unknown or other
  misc_feature (398)..(398): n is a, c, g, or t
  modified_base (507)..(507): a, c, t, g, unknown or other
  misc_feature (507)..(507): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtagacactcgtaccggggaaaatcggtcgctggacaacaatcggttaggaattaggattaggcagtccccgtgagaggccttgagtggcgtaggaagacctatatacgtccagtgtatgaacgactagtgactagattctgtgagtcggtcgtctacgacctacnccaacccgacgaccaacgtccaaacgaactcacggtcctaccctaccaaaccttaatcgtctacgtcaaccgtcccgaacgacgaacggtcttaagttttactttacgngtacaacggtaggactaccgtactacggttcgacgtaaccgttacctacgttacggaccttaccgggtcgggtacccgtagggtttaacccgg

SEQ ID NO: 213209 - DNA, 753 bp, Homo sapiens
  misc_feature: GYAE6OF02F1XAG.21.27.C05.1.454.CMB.1.raw
  modified_base (198)..(198): a, c, t, g, unknown or other
  misc_feature (198)..(198): n is a, c, g, or t
  modified_base (215)..(215): a, c, t, g, unknown or other
  misc_feature (215)..(215): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (718)..(718): a, c, t, g, unknown or other
  misc_feature (718)..(718): n is a, c, g, or t
tcagtcgtcgctcgcacgaccggtgctcgatttagacgcgatcgaagggtttgggggaggaactgctcagttaggacccagaccggagccatggaagccccagcgcagcttctcttcctcctgctttctctggcctcccagaccaccactgggatgattgtgatcgaccgcagtcctccagtccaccctgtctaggtntcctccgaggggggtanccgcccaccctctccgtagcacgagtccagtccagtctagtcgtctgaccgttggttaacgccgttacgggtaccaggaccaaggtaaacttccgtggacctagggccttacccagggtccctaccttcgaactttttccggngtccaacgtccgaaccnggggtacccagtcggtcgtacccaggtactcggttcgaggtcgcgggtagtagtttacggggaactaggttacttttccaccggttaccaactaacgtctacggtacccgtacccgtagacggtacgtcgaaaagtcgtaggttcgtacttaggttttactttcgtccggtaacctacgtaaccgtaaagtttaacgtttaaccgttacgtaccgtttacccggtaggttccccgtaacggggtttaacccgtttcgggaaaccccgtaccggggtaacccgtaacggggtaacggaaacgtttaacccggaaacggttacggtcgggtaacgcgggttaacnccgtaacctaggtttcccgtatttccccgttaacg

SEQ ID NO: 213210 - DNA, 675 bp, Homo sapiens
  misc_feature: GYAE6OF02IYM3S.21.27.C05.1.454.CMB.1.raw
  modified_base (205)..(205): a, c, t, g, unknown or other
  misc_feature (205)..(205): n is a, c, g, or t
  modified_base (429)..(429): a, c, t, g, unknown or other
  misc_feature (429)..(429): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcctccgaggggggacnccgcccaccctctcctgcacacgccagtcagtctatcgctgacgttggttacgcctaggtaccagtacaagaaacttcgtcgggccacgggcctaccccgaggcccttcccgtactacgtttaccgtcgactacctcccgaccgcgggcctacgtcggtcgtacccagtaccgtggttcaaggttcgggcggttaggtacgtttcgggactaaggttcttttcnctaccaccgtatcgtaccgccgtaccctagaaggtagtagaaagtgttagtcgtacgttaggttttacttcgtacgacctagtacctaagttaacttaagttacgtccggtacgttcggtaccgttacgttaccgggtcggaaccccggtaacgggtaaccgtaggtaaccggtaactaaccggtaaacgtacgtacgtacggtacgttaccggtacctaccgtacgttccgttcgtaccttaccg

SEQ ID NO: 213211 - DNA, 794 bp, Homo sapiens
  misc_feature: GYAE6OF02JCO4E.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgcccgtgctggcctccagtggggtctcctgtcacgagatacaaactcagctagtctggtccaggactggtcgacggccctgccagtacccttcactcactgtacacatcgtaccggggaaaatcgtcgctaggactaacgtagtaggttacggtaagttggtaattacggtccgtaccgtccccggtaggtaacgtacggtccgttaggacggttcggtacgttagggaacggtacctttaagttacgtaacccggtaccgtaggttagggtaacttacggaaagtcgttaagtgtacgtagtattcgtagttcggacggtcggttctctaccgtaacctacgtacccgacccgaggtaacccgtaacgttaaccgaaacggttaaccgtaccgtaaccgggttacccttaccccgtaacttaaaccgttaccgttacgttacccgttaccgttaacccgtacccgttacccggtaaccggtaacccgtaccggtttaaccgtttagttttaaaccggtttcgtaaccgggtaccgtaagggttacgtaacggtaccgttaaccggttaaccgggtttcggtaccgaacccgttttacccgtacccgtttacgtacccgggttaccggtccggggtaacccggtttacgggtttaacccgg

SEQ ID NO: 213212 - DNA, 774 bp, Homo sapiens
  misc_feature: GYAE6OF02HSAZS.21.27.C05.1.454.CMB.1.raw
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
tcagtcgtcgctcgcacgaccggtgctcgatttagacgcgatcgaagggtttgggggaggaactgctcagttaggacccagacgggagccagtggaagccccagccgcagcttctcttcctcctgcttctctggctcccagacaccactggagtgattgtgatcggacgcagtctccagccaccctgtctgtgtctccggaggggggacnccgcccacccttctcctgcacacgccagtcagtctatcgntagctggttacnccgtggtaaccngacaagaaacttcgtcggacccgaggtcctccccgtacggtccctcccgttacttacgttttacccggtgtccaaccttccccgaaccggaccggggtccctaaccggtttcgggttaccgtaccccgaaggtaaccgttacggtttaccggtaacggggttcgggggttaccgggggttagggtttacggttttcgggggaaccgttaggtttacggttttttccaccgttaccctaacctacgttacgccggccccgtaccctaacgtaggtacggtagaaaggtgttaggttcgttacgttagtttttacctttacgtcgtacacgtaataaacgtttacttaaacgtttcgcggttacctacggttccgtacggttaccgggtccggaacgtaccgggaacgtacgggttacgaaacgttaacccgtaaaccggaacgttgggtaccggtacgtaccgacccgttaccgacttttaccgttcttaccgtttacccg

SEQ ID NO: 213213 - DNA, 675 bp, Homo sapiens
  misc_feature: GYAE6OF02GPHOM.21.27.C05.1.454.CMB.1.raw
  modified_base (185)..(185): a, c, t, g, unknown or other
  misc_feature (185)..(185): n is a, c, g, or t
  modified_base (227)..(227): a, c, t, g, unknown or other
  misc_feature (227)..(227): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccccgtntgtgtctccggaggggggacgccgccacccgtctcctgcacncgccagtcagtctagtcgctgactggttacgcctggtaccagcaagtaaactcgtggcccgaggcctccgaggtccttacctctacgtttaccgtcgacctactcccaccgacgggcctacgtggtctccgagactaggttcgaggtgggtcggtaggtagtttcgggaacgtagtttacgttttctacgtacctaaccgtactcgtacggcccgtacccgtacgaaggtaacgtacggaaagttacgttgttacgtattacgttttatttccgacgtaccgtagtaacctaatttaaccgtaagtttaccgtcggtaccgttcggtaccggttccgtaccggttacccggaccggtaaccgggtaccgtaagggtacgaaacgtaacgtaacggtaacgttggtacgtctacggtaccacgttacgttcgtcgttacttcgtacccg

SEQ ID NO: 213214 - DNA, 780 bp, Homo sapiens
  misc_feature: GYAE6OF02FXAUY.21.27.C05.1.454.CMB.1.raw
  modified_base (427)..(427): a, c, t, g, unknown or other
  misc_feature (427)..(427): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtcgtcctgtcacagactacaaactacagacagtctcggtccaggactggtcgacggccctcgcaccgtaccctttcacctcaccgttgtacgactacgtaccgtaaccggggtaaatcgtacgcgtaggaccaacgtaggttaggttacggtaagttaggtacgttaaggctaccggttaccccgtaggtaacggacggtccgttaggacggtggtacgttacgggaacgtaccttaacgttacgtaaccgtaccgtagttagggtanagtaacgtacttagcgactaacgttagttaccgttaggtcggtaacgggttccggttaccgttaccgacccgtaacctaccgtaaccccgaaccgtaccgaccgttaaccgtaaccaaacgttaccgtacggacccgttacccttaccccgtactaacccgttagtcgttacctacgttacccgacccgtaacccgaccgtaccgtacggttacctttaaggttttaccgttcggtaacgtacggtaacggtaggttaccctaccgttaacggttaaccgttccggtaccgttaacgtttcccttaccggtttacgcccgttaccgggtcggtaacccggttggttaaccccg

SEQ ID NO: 213215 - DNA, 712 bp, Homo sapiens
  misc_feature: GYAE6OF02JG99F.21.27.C05.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctcagccacctgtctgtcgtctcgagggggacncgccaccctctcctgaccacacgccacgtacacgttctagtccgacttgacgttggttacgccgtacggtaccaggtacaaagtaaactcgtacggccgtaacggcctaccccgaaggcccttccctacggttacgtttaccgtcgtactaaccgtacccaacccggacgggtaccctaacggttcgggtacctacccgaagaccgttaacgggttacagggtcgggtcggttagggtaggtttacggacgaagtttacgttttccacgttaccacctacgttcgaaccgtccgtaccgtaacgaggtaaggtacgaagtacgttcgttacgacgtttaagttttacgttccgttaacgacctagtaactaaagttaaacgtaactttacgtacgtccgttacggtcgttacgtacggtccggtaccgaacggtacgtaaggtagaacgtcggtaaagtacgtcggtacgacgtacgacccgtaatacgttaccgttacgtaccgttaccg

SEQ ID NO: 213216 - DNA, 697 bp, Homo sapiens
  misc_feature: GYAE6OF02GXVUS.21.27.C05.1.454.CMB.1.raw
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (422)..(422): a, c, t, g, unknown or other
  misc_feature (422)..(422): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgacttggttacncctggtaccagcaagaaatcgtcggccaggcctcccgaggccttccgtactacgttttaccgngacctacttccccaaccgcgggtacccacggttcgggtctaccccaaggtaccgtagggttccaagggtcgggcggttaggtacgtttggactaggttacgttttcncgtccacctatccgacgcccgtacccgtaagacgtagtacggtaagtagttggtacgtcgttaagttttactttcgttacgaccgtagtaactaaacgttaatttaaaccgttacgtacgggtccttggtaccggtttacgtaccgggttcggaacccggtaaccgggtaaccggtaagggtaacggggtaaaactcccggtaaaaacggttaccggtagggtacgtaccggttacggaccgtaaccgttacgttaccgttcggtacctttaccg

SEQ ID NO: 213217 - DNA, 737 bp, Homo sapiens
  misc_feature: GYAE6OF02H0IS1.21.27.C05.1.454.CMB.1.raw
  modified_base (159)..(159): a, c, t, g, unknown or other
  misc_feature (159)..(159): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctccagtggggtntcctgtcacagactacaaactacgagcagtctggtccaggactggtgacggcctcgcacgtacccttcactctaccgtgtagacagttccggtaacggggtaaatcggtccgcgtacggaccaacgtaagttcgggttagtaagttggagttacggaccgtaccgtccccggtaggaggtacggtccgtgacggtggtacgttaggaacgtaccttagttacgaccgtccgagtggtatgaagactagtcgagtagtcttgtgtgtacggtcgttcgtacctccaccgtactacccgaccctacgaccgtacctaacgaaagtacgtcgacggttaccctacccgtaccgtaacttacgttcggtcctacgttccgaacccgtacccggtaaccgtaccgtaccggttacgttttaacggtttttacgttttacggaacgtaccgtaacgggttacggtacctttaccgtaaaccggttcggttaaccggttaaccgttaaccccgtttacccgttcccgttaacggttaccccgttccggggtaaccgggttacccggttaacggttttaaccccgg

SEQ ID NO: 213218 - DNA, 719 bp, Homo sapiens
  misc_feature: GYAE6OF02G0EJP.21.27.C05.1.454.CMB.1.raw
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (316)..(316): a, c, t, g, unknown or other
  misc_feature (316)..(316): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcnccgaggggggacnccgccaccctctcctgcacanccagtcagtctatcgctgactggttacnccgttggtaccagcagaactctaggccaggtctcccgaggtcctaccctcgtactttaccggngccactcccaccgacgggtccacgtcggtcgtcccaaggtaccgtaggttacgcgggtcgggcgggttacgggtaggttttacggggacgtagggtttaccgttttttccaccgttaccgaccctagttaccgacgcccgacccttacgaggtagtaggtaagtacgttggtcggtacttagtttactttcgtcgtacccgtgtaactaaacttacgtttaaacttacgttcggtccgttacggtaccggtttacgtaacccgggtttaccgggacccggtaaccggggaaccggtagggttaaccggtaaacggtaaccggtaaaccggttaacggtacgggttaccgtacggttaccggtacctaacccgttaccgtttcgtttaccgttacgtttacccg

SEQ ID NO: 213219 - DNA, 724 bp, Homo sapiens
  misc_feature: GYAE6OF02FSDVD.21.27.C05.1.454.CMB.1.raw
  modified_base (208)..(208): a, c, t, g, unknown or other
  misc_feature (208)..(208): n is a, c, g, or t
  modified_base (324)..(324): a, c, t, g, unknown or other
  misc_feature (324)..(324): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccacgccacccttgtcctgtggtactccgagggggacnccgcccacccgtcctccgtcgacaccgagaccctagtccgacgttactactcggctgtacgttggttacgaccgtggtaccagcgaacgaaagtcgtcggccgaggtcctacccgnggacctccgtctacgtttacccgtcgacctacttaccgaccgacgggcctaccgtggtccgtccgacgacgtaggttcgaggtcggtcgggtggtagttagggacgtagttagtttccgtcctcgtacctatccgaccgtccgaccctacgaaggacgttaggaagtacggttagttcgtacgttacgttttacgttccgttacggtactaacgtaccttaaagttacttaacgttacccgttcggtcccgttacggtaccgttaccgggtaccggttaccgggacccggaacccgggttaaccggtaacgggtaaccggaaacgttaaacccggtaaacggttacgtacgggttaacgtccgtacgtacgaaccgttacgtcgtttaccgtcttacccg

SEQ ID NO: 213220 - DNA, 754 bp, Homo sapiens
  misc_feature: GYAE6OF02HY81R.21.27.C05.1.454.CMB.1.raw
  modified_base (87)..(87): a, c, t, g, unknown or other
  misc_feature (87)..(87): n is a, c, g, or t
  modified_base (341)..(341): a, c, t, g, unknown or other
  misc_feature (341)..(341): n is a, c, g, or t
tcagtcgtcgctcgcacgaccggtgctcgatttagacgcgatcgaagggtttgggggaggaactgctcagttaggacccagacgganccatggaagcccccagcgcagcttctcttcctcctgcttctctggcctcccagacacccacgtggagtgaattggtgatagacgcagtcctccacgccccacccttgtcctggtcgtcgtccgagggggggaccgcccacccctctcctgcacagccagtcagtctatccgctagacttggtacgccgtggtaccagcaagaactcgtcggaccaggcctacccgacggtcctacccgtacctacgtttaccgngtaccactacccgacccgacggcccacgtcggtacgtacccgaagtacgtacggtacgaggttcgggcggtaggtagttggtaacgtggtttacgtttacctcctacctaacgactacgacgtcccgtacccaagtaacggtaggtagtaaagtacgtcggttagtacgttacggttttacttcgttcgtaccgtacgtaacttaaagttaacgtttaaactttacgggttacgttacccgttacggttacccggtttaccgtaaccgggtttaccggaacccgggtaaaccgggaaccggttaacggttaacgggtaaaccgtaaacccgaaacggttaaccggtgggttaacccgtggtacccggacccgtaaccggttaacgttacccgtttagtttacccgttaacccg

SEQ ID NO: 213221 - DNA, 644 bp, Homo sapiens
  misc_feature: GYAE6OF02IWBH1.21.27.C05.1.454.CMB.1.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (335)..(335): a, c, t, g, unknown or other
  misc_feature (335)..(335): n is a, c, g, or t
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
tcagtcgtcgctcgcacgaccggtgctcgatttagacgcgatcgaagggttttgggggaggaactgctcagttaggaccccagacggagccatggaagccccagcgcagcttctcttcctcctgcttctctggctcccagacaccactggagtgattgtgatgacgcagtctccagcccacctgtctgtcgtctccggagggggganccgcccacccttctccgtgccacacgccaagtcagtctacncgctgacgttggtacgtcctaggtaccagacaagtaaagtccgtggcccaggccctacccgaggtccctcctacgttactttaccgngcctacgtcccaccggtacgggccctaacgttcggacctcccgacgtacgtggttacgagggttcgggcggtggttgttagggacttagttcgtttcnctacactgctaccgcgtacccagtaagtagtagtaagtagttcgttntacgtttagtttagttctacgaccgtatactaattacttaagtccgtgtaccgtgtcgtacgttcggtacggaccgtaacggaacgtaaggtacgtaaacggtaacgtaaacggttagttcggtacgtacgtacgaccctacgtcttaccgttcgttacttccg

SEQ ID NO: 213222 - DNA, 901 bp, Homo sapiens
  misc_feature: GYAE6OF02IQYMV.21.27.C05.1.454.CMB.1.raw
tcagtcgtcgctcgcacgaccggtgctcgattttagacgcgatcgaagggtttgggggaggaactgctcagttaggacccagacggagccatggaagccccagcgcagcttctcttcctcctgcttctccgtgcctccagaccaccacgtggagtgtatttgtagtagtgaccggactacgttcctacccgacgacccctaccccgtgtcgttcgttcgtccgtaccgggagggggaccgcccgacccctaccccttccttccgtcgacctacgacgccctaagtccgtacttacgttacgtcgtcgtcgtacggtttggttacctccgttaacggtaaccaggaactaaacgtaacgttcgtaccggaccgacgtccgacccgtccggtcccttccttaacgttaccgtttccgacgacctacctcccggaccggtaccggccttacggttccgtaccgtaccgtaacgtaacggttacgttaggacggttcggggtacggtttaggtttaacgggtttaccggaacggtttacggtttttcccggtttcctaccgttaccccgtaaccttacgtaccggtacccgtccccgtaaacccgttaacggaagtaacggtagtaacgttacgttggtttaaccgttcgtttttaaacgtttcccgttttacgaccgttacccgttaagtaaaccgtttaacgttaaaacgttacggttttaccggtccgggttaccctttcggggttacccggttttacgggtttaaaccggtttacggaaacccgggtaaaccgggttaggttaacggtaaacgtaaaccgttaaaaccggtaaccggttgttaaaggggccgtttagacccgtaccttaacgtccgttttgtttacctttccgtaaccccg

SEQ ID NO: 213223 - DNA, 844 bp, Homo sapiens
  misc_feature: GYAE6OF02G64AE.21.27.C05.1.454.CMB.1.raw
  modified_base (172)..(172): a, c, t, g, unknown or other
  misc_feature (172)..(172): n is a, c, g, or t
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggacgtgattgtgatgacgcagtcncagccacctgtctgtgtcctcggagggggancgcccaccctctccgtgccacgacgccagtcgagttctactcgactgtacgttggttacgccttggtaaccgacgagtaacgaacttcgacgaccgaggtcctaccgacgtcctaccgtcttaacgtttaccggtgtcctaccgtaccccacggaacgggtccctaagtcggtaccgtaccgataccggtacgtttcgagggtcggtcgggtttagggttacggttacgggtcgttaacgggtttacgtttcctaccgtaccgtaaccgttactaccggacgtacccccgtcccggttaaaacgacgggtagttaaccgggtaaagggtccgtttaaggggtttaccgtacttttaacggtttttactttacccggtaccggtacgtttaaaggtacccttaaaagttacgttttaacccggtaaacggtttccgtacccgggtcgttaacccgggttaccggggtttacccgttaaacgggggaccccgttaaacggggaaaccggttaggggtttaaacggaaaaccgtttaaccgggaaaacccggtttaaggccccgggggtttaaagtaccccggtttaacgaaccccgtttaaacgttcccgggtttaacgtttttacccgaccttttacccggg

SEQ ID NO: 213224 - DNA, 811 bp, Homo sapiens
  misc_feature: GYAE6OF02HNS8V.21.27.C05.1.454.CMB.1.raw
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (776)..(776): a, c, t, g, unknown or other
  misc_feature (776)..(776): n is a, c, g, or t
tcagtcgtcgctcgcacgaccggtgctcgatttagacgcgatcgaagggtttgggggaggaactgctcagttaggacccagagggaaccatggaaaccccagcgcagcttctcttcctcctgctactctggctccagctcagaaaccacggaagaaattgtgttgacgcagtctccaggccacctgtctttgtcctccgaaggggaaanacgcccacctcgtcctgcagctccagtaccaanaactacgtaccaagtacgacttaccgtaacacgttaacggccgttagggtaaccctaggtaccaaaggaacggtccccgtacggggaccctaaacgggtcccttaaccccgtaacggttttaccccactaattacccgttaagcgtccgttacggggcccaacggtacggggccctaaagtcgggacctaacctcccgaaaggaccgtcggtttacaggtacggacgtacggggttaggtacgtacgggacgtaacgttccgttacgaccttcgtaaccacgttaactaggttaacgcgtaaacgtcgtaaggacctacgtagtaaacgttacggttacacggtaaaggtttacgttaacggtttaaacctcgttacgtaccgtaattaaccgggttaacgttaacggggtttaaccttactaaccgtttccgttttaacgggttacccgggttaaccggtaacgttaaccggggaactttaaacgggaaagtaaccggttaacgtaaaacgggtaattacgggacgttaaccncggtaacctacggtactttacggttaccttaacgg

SEQ ID NO: 213225 - DNA, 777 bp, Homo sapiens
  misc_feature: GYAE6OF02J1K9G.21.27.C05.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagtcccaccctgtctgtcgtctccgaggggggntccgccacccgtctccgtgccacacgcctagtccaagtcctattccgctgacgtggttacgccttggtacccagccaagtaacgtcgtacggccgaggccctaccgacggtcctccgtacttacgtttaccgcgtactaccgtccgacccgtaacgggtccctaaccggttcggtacccggtacccgaacggtacgttaacggttccggtaagtttcgggggaccggtaggtttaccgtttacggggaactaacgggtttccgttttcctccgtaccgaacctgtaccgtaccgtaccgtaccccgtacgaaggtactagggtaacgtaacgtttggtacgtacgtttaactttacgtttcgtaccggtaccgtacgtaaacgttaaacttaaacggtttacgttaccgtccgggttcttaaacccgggtgggtttaaccccgttcggggtttaaacccggaccggttaaccggggaacgttacgggtaacgtaacgtaaccggtaaacggttgtaaccggttcgaccgtttaccgacctaggtaacctttcgttacccgtaccgtttaacg

SEQ ID NO: 213226 - DNA, 656 bp, Homo sapiens
  misc_feature: GYAE6OF02ICRBS.21.27.C05.1.454.CMB.1.raw
  modified_base (246)..(246): a, c, t, g, unknown or other
  misc_feature (246)..(246): n is a, c, g, or t
  modified_base (329)..(329): a, c, t, g, unknown or other
  misc_feature (329)..(329): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggactcccagacaccactggaagtgattgtagatgacgcagtctccagccctacctgtctgtgtcctccgaggggggactcgccacccgtctcctgcacagccagtcagtctatcgntgactggttagccttggtaccagcgaagtaaatcgtcggacctaggtacctcccgaggtccctccttacttacgtttaccggntcgtacctcccgaaccgacgggtaccctacgttcggtccgtacccgaagtaccgtacggttcgagggtcgggtcgggttaggtacgtttacggggacgttaggttacgtttttcaccgtacctaaccgtacgtacgacgtccgtaccctacgaacgtaggtaagtaagtacgttacgttcgttacgttaagttttacttacgtacgtaccgtagtactaatacttaattacgtcgtcgtcgtcgtcgtacggtcgacgtacggacgtaggtacgaacgtacgaacgtacgtcgtagtcgtacgacctactacgttctacgtctaccg

SEQ ID NO: 213227 - DNA, 776 bp, Homo sapiens
  misc_feature: GYAE6OF02HAJSG.21.27.C05.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggccctccagtgggtntcctgtcacagatacaaacgtacagactagtcgtggtccagggactggtgacgcctcgcacgtacccttcactcaccgtgtagactactacggtaaccgggtaaaatcggtcgcgtacggacaaacgtaagtgggttagtaagtggtaagttacggcgtaaccggtcccggtggaggtacggtccgtaggtaggtcggtacggttaggaacgtaccttaagttacgtaccgtacgtaagtggtaacgtaggaacgtacgtagtcgtagtagtattcgtgtaggtacgtcggttctaccgtcgactacgtacccgtaacccgagtaaccgacgtaacgaaacggtactaccggtaccgtcctacccgtaacctaaccgttaacgttcgtacctacgtaccctaacccgtacccgtacgaaccgtaccggtaaacggttttcttttaacgggtttacgtaacggtaacggtaaacggtaccgggtacgtttaaccgtaaccggtttaacggttacgggttaaccccgttaaaccgtttccccgttaacggttaacccggttccgggttaccccgggttaaccgggggttacccgggttaacggggtttttaaccccgg

SEQ ID NO: 213228 - DNA, 747 bp, Homo sapiens
  misc_feature: GYAE6OF02JQAGA.21.27.C05.1.454.CMB.1.raw
  modified_base (263)..(263): a, c, t, g, unknown or other
  misc_feature (263)..(263): n is a, c, g, or t
  modified_base (376)..(376): a, c, t, g, unknown or other
  misc_feature (376)..(376): n is a, c, g, or t
tcagtcgtcgctcgcacgaccggtgctcgatttagacgcgatcgaaggtttggggaggaactgctcagttaggacccagacggagccatggaagccccagcgcagcttctctcctcctgcttctctggcctccagtacaccgactggactgattcgtgatgacgcagtctccagcctacctggtctgtgtctaccgaggggggactcggccctaccgcgtccgtagcctacaacgccgaaggtcctaggtacctatccgactnacgttgtagcctggtccacgcagaatctaggccgaacggcctcccgaaggtctcctacgacgtttaccgagccgtactcccaaccggtagggccccctaagttcgggttaccncccgtaaggccgttaacggtcgtaacggtcgggtaccggtaggtagtttacggggactaccggttaaggtttccaccggccttaacgtcgtacgtaaccggtccgtacccggttacaaacgggtacgttggtaaaaccgttcggtacggtttacgacggtttaaggtttacctttccgtacgtccgtaaacgtctaaattaaccgaaggttttacctccgggtacctaacgtccggtaagttacccgggtacgaacccggtacgggttaaccgacgggtttaacgaaccgtaaccgtaaacggaccgttaaccggtttggaaccgtttacggcccgttaaccgtacgttaccgtttaacggcttaccccgg

SEQ ID NO: 213229 - DNA, 709 bp, Homo sapiens
  misc_feature: GYAE6OF02IPP2Q.21.27.C05.1.454.CMB.1.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
tcagtcgtcgctcgcacgaccggtgctcgatttagacgcgatcgaagggtttggggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggncgccaccctctcctgccacacgccagtcagtctatcgctgacttggtacgccgtaggtaccagcaagtaactcgtcggacctacggcctacccgaggtcctccttactacgttttaccgngaccactcccaccgacgggtccacgttggtccgtacccaggtacgtaggtttcgaagggttcggggtccgggttagggttacggtttaggggacgttaaggtttacgtttttcctaccgttaccctaaccgtactccgtaccggtcccgtaccctaacggaggtagtacggtaagtacgtttggttcgtactttaggtttactttcgacgtacctagtaactaagtttaacttaacttacggtcgtaccgtcggtaccgttacggttaccggttccggaccggtaacgggtaaccgaagggttaacgtaaccgtaccgtaaaaccggtggttacggtaccggacgttcgaccgtaacccttagttacgttccgtttaccttacccg

SEQ ID NO: 213230 - DNA, 881 bp, Homo sapiens
  misc_feature: GYAE6OF02GQ929.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgagggggancgccaccctctcctgccacacgccagtcagtctatcgctgacgttggtacgccgtaggtaccagcaagaaactcgtcggaccacggcctacccgacggtccttccctactaacgttttacccggtagacctacttaccccgaaccgacggggtccccacggttccgggttaccgtacccaaggtaaccgtacggtttacgaaggggttcgggacgggtttgggtaacgtttcggggaaacttaacgggtttcgtttttacctaccgttaccaacccgtaacgtccgtaaccggtacccgtaccccttaaacgaacggtaggttaaaggaacggtaacgtttcgggtttaacgtttacgttttaacggttttttaacttttacccgttacgtaaccggtaacgtaaacctttaaaagtttaaaaccgttttaaactttaacccgggtaccggtttacccggttacggtttaacccggttaccggtttaacccggggtttaaacccggaccccgggtttaaaacccgggggaaaccgttaaacgggggtttaaacggtaaaaacccggttaaacggaaaaacccgggtttacgggttaaaccgggtacggttaaacccgttccggtaaccttaaaccccgtttaaggttcccgtttttaccggttacccctttaaaccccg

SEQ ID NO: 213231 - DNA, 1103 bp, Homo sapiens
  misc_feature: GYAE6OF02IXLXY.21.27.C05.1.454.CMB.1.raw
  modified_base (174)..(174): a, c, t, g, unknown or other
  misc_feature (174)..(174): n is a, c, g, or t
tcagtcgtcgctcgcacgaccggtgctcgatttagacgcgatcgaagggtttgggggcagagcctgctgacttctgggctgaccagggcagtcaccgggagctccagacaatgtctgtctccttcctcatcttcctcgccgtgcgtcggcctccagtcggggtcgtcctgtcanagtatacaaactacagcgtacgttcgtcggtaccgaggtacgtggaggtaccggtccctcggacgtacgtaccctttcacctccgaccgtcgtacgtactacgttaccggtaaccggggtaaatcggtacgtccggtacggacctaaaacgttacggttcgggtttaagggtaacgtttagggtaacggtttacggtacccggttaaccggttccccccggttacggggaaccgggtaccgggtcccggtttacggtacggggttaccgggtaccgggtttaacggggtaaccgggttactttaaccgtttacccgttaccccggggtaccggttaagggttaaccggggttaacgtacgggtaaacggtttaacggttacgttacggaaccttacgggttaacggtttacccgttaggggttacgggttaccgggtccggggttttaccgtacccgttaccgtaaccccggttaacggtttaccccgtaacccccggtaaacgggtaccccgtaacccgggttaaaccggtaaaccgtaaaaccgggtttaccggttacccgggtttaccccggttaaacccccctttacccggttaaaccccgttaaacggtttcccggtttacccggttaccgggttaacccccttaaaccccggggtacccccgtaaaccgggttaccccgggtaaaccgtttacgggtttttaacccgtttttttaacgggttaccgttaaacgggttaacccgggttaaccggggttaaccggggttaccccggtttaaggttaaaccccggtttaccgggttttaccccgggtacgttttaaacccctttaccccgggttccggtttttaacccgtacccggggttttaaccgggtaaccccgggggtttaacccggtttaaccgggggttttaaccccggg

SEQ ID NO: 213232 - DNA, 746 bp, Homo sapiens
  misc_feature: GYAE6OF02FLLKJ.21.27.C05.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtctccgaggggggncggcccaccctctcctgcacacgccagtcagtctatccgntgacgttggtacgcgtggtaccagacaagtaatcgtaggccaggcctcccgaggtcctccctctacgtttaccgngacctactcccgaccgacgggtccctacggtcggttaccgacccgaaggtaccgttacggttacgaggggtttcgggtcggggttaggtacggttttacggggaacttaagggtttccgttttttaccgtaccgttaacctaaccgtactacgtaccggcccgtaccccgttagaacgtaaggtacgtaaagttacgttcggttacgtactttaaggtttttctttaccgtacggtacctaacgtacttaaagttaactttaacttaaccggttcggtaccgttcggtaccggttccgtaaccgggttcccggaaccggtaccgggaaccggttaaggtaaccggtaaacgtaaccggaaaaccgttacggtacggtacggttactacggtaccgaacctttacgtcggttaccttccgtttaacccg

SEQ ID NO: 213233 - DNA, 725 bp, Homo sapiens
  misc_feature: GYAE6OF02HQ8EE.21.27.C05.1.454.CMB.1.raw
  modified_base (163)..(163): a, c, t, g, unknown or other
  misc_feature (163)..(163): n is a, c, g, or t
  modified_base (228)..(228): a, c, t, g, unknown or other
  misc_feature (228)..(228): n is a, c, g, or t
tcagtcgtcgctcgcacgaccggtgctcgattttagacgcgatcgaagggtttgggggcagtagccgtgctgacttctggctgaccagggcagtcaccggagctccagacaactgtctgtctccttccacatcttcctgcccgtgctggcctccgatggggtntccgtgtcacagactacaaactcagcagtctggccaggctggtgacgccctgcgacgtccctttnacttcacctgtcgacagtccgtacgggtaaatgtcgcgtggacaacgaacttggttacggtaagttcggtaagttacggactaccggtaccccggtacggacggtacggtccgttaggacgttcggtacgtttcggaagggtacccttaagttacctaacgtacccgtagttcggtaagttcggaagtaccttagtcgtaactagtacgttacgtcgtaggtacggtccggtaccgtccgttaccgaccgtaaccgttacccgaaccccgtagtaaccctaccgtaacgtaaacgtacgtaaccgacggtacccttacccgtaccaaccgttacgttcgtccgttctacccgaccttaccggaccgacgtacggttcgttaagtttttacgtttcgacggtacgtaagtacgggtaataccgagttaccgttcgtaacgtacccgtttccgtccgttacggccgttaccggacgggttacccgagggtttaacccgg

SEQ ID NO: 213234 - DNA, 858 bp, Homo sapiens
  misc_feature: GYAE6OF02I6HZ4.21.27.C05.1.454.CMB.1.raw
  modified_base (183)..(183): a, c, t, g, unknown or other
  misc_feature (183)..(183): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
tcagtcgtcgctcgcacgaccggtgctcgatttagacgcgatcgaagggtttggggggaggaactgctcagttaggacccagacggagccatggaagccccagcgcagcttctcttcctcctgcttctctggcctcccgagacaccactggagtgattgtgatgacgcagtcctaccacgccnccctgtctgtcgtctccggaggggggacnccgccctaccctcgtccngccacgcgacctagtcgtactctatccgtctacgtacttggttacgccgtcggtacctacgacaagaatcgtccggccgtacggcctacccgaggtcccttacccttcttaaccggttttacccgtcgtacctacctaccccgtaccggaccgggaccctacggttcggtcccgtaacccgtacggtaaccggtaccggttacgggacggtcggggtgggttacgggtttacggtttcggggaacggtttacgtttccggttttaccttaccgtaaccgtaccgtactaaccgccgtaccggtaccccgtaggaaccggtaaggtaccggtaaacggtacggtttacgttacggtacgtttttaacgttttacgttacgtaccgtaccgtacgttaaacgttaaagtttaaacgttaaaccgtttaaccggtcggtttacccggttaccgtaccgggttttaccgggggtaacccggtacccgggttaaaccgggaccggggttaacccggaagggttaaccggtaaaccggtaaacccggtaaccggtttaaaggtccggttaaccgggtccgttacccggtaaccgttacctaacccggtttcgttaccgtttacccgttaacccg

SEQ ID NO: 213235 - DNA, 768 bp, Homo sapiens
  misc_feature: GYAE6OF02IWPMA.21.27.C05.1.454.CMB.1.raw
  modified_base (502)..(502): a, c, t, g, unknown or other
  misc_feature (502)..(502): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttctgacagtcgctgggcctccagtggggtgtcctgtcactagactactaaacctcgaggctacggttctgggtcccagggtacgtggtacggacggtcccctacggctaccgtacccctttcaccttaccaccgtgtacgactacgttaccggtaaccgggggtaaatcggtccgtacgtacggacctaaacgtaaggttacgggttacggtaaagttggtaacgttaacggacgtacccggttcccggtacggtacggtacggttaccgttaggacggtcgggttacggtaacggtaacggtaccttaagttaccggtcccggtaccgtaggttacggtataaccggtaactacgtagtcgacgtaagttnttaccgtggtacggtaggtccgtcgttctaacgaccctaccgtaccacccggtaacgaaccgtaccgtaacgtaacggtacctcggaaccgttcctacccttaccgtaactattccgtacgtctaccgtacccgtacgtaccgtaccgtaccgtacgttttaatttcggttacgtacgtacggtaggtacgtacgacttaaccggttacggtctaccgtacctttacgtacgttccgtaccgtcccgggtaggtaccggttaacgg

SEQ ID NO: 213236 - DNA, 850 bp, Homo sapiens
  misc_feature: GYAE6OF02IJ9N0.21.27.C05.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtgggtgtcctgtcacagatcaaactacagcagtctggtccagggactggtgacggccctgcagtaccctttnactcacctgtgacatccgtaccggggaaaatgtccgcgtcgactaacgaagtcggttaggtaacgttggagttaggaccgtaccggtaccccggtgacggtacgggtccgttggaggtggtacgttggaacggtaccttaagttacgttaaccgtacccgtagttacggggttatagggtaaacgtacgttaacgtcgtacgtaacggtaacgtttccgtagggttacggtaacgggttaccggttacggttccgtaccgtaaccgtaccgtaacccgaaacccccggtaacgtaaacccgtaacccggttaaaccgtaaaacgggtaaacgttacccggttaacgggttaccccttaccccgtttaacccgttaaacccgtttaaacgttccgtttaaccgtaccggtttacccgtaacccgttacccggtaaccggtaacccgtaacgggtttaccgtttaacgtttttacggtttttacgtaacggtacgtaacggttaagggttccgttaacggtaaccgttaaccggtttacggttaaccgggttaaccctttacccggttccgttaaccggttacccgttacccggggtaccgggttacccggtacgggtttaacccgg

SEQ ID NO: 213237 - DNA, 766 bp, Homo sapiens
  misc_feature: GYAE6OF02IZDK0.21.27.C05.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccaccctgtctgtgtcctccgagggggacgccgccaccctctcctgcacacgccagtcagtctatcgntgacgttggttagccgtggtaccagacaagtaatcgtcggaccgacggtccctacccgacggtccctacccgttacttacgttttaccggcgtacctaccgtaccccgaaccggtaccgggccctaacggtcggttccgtacccgagtaaccggtaggttcgagggtcgggtaccgggttagggtacgttttacgggacgtacggtttacgtttttcctaccgtccgtaaccgtactaccggtacgtccccggtaccctaacgtaaggtaggtaagaagtagttacgttacggtacgtttagtttactttcgtccgtaccgtacgacttaaattaactttaaacgttacgttaccggtaccgttacggtaccggtttaccggttaaccggttccgggaaacccgggtaaccgggtaaccggtaacgggttaacgtaaacggtaaaccgaaaccggttaaacgttcgggttaacggcctagggtacccctaaccgttacgtttccgtttacgttaccgttaccg

SEQ ID NO: 213238 - DNA, 848 bp, Homo sapiens
  misc_feature: GYAE6OF02FHP3V.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgctttctctggcctcccagacaccactggagtgattgtgatgacgcagtctccagccacctgtctgtgtctccgagggggancgccacccttctcctcgcacgacgccagtcagttctagtcgctgacttggttacgcctggtaccagacaagtaactcgtggaccacggcctacccgaggtccttccctacgtacgttttaaccgtcgacctacgttcccgaaccgacgggtccctaacggttcggttaccgtacccgtaacggtacgtacggtttacgaggttcgggtacggggttcgggtttaagtttacgggggtaactacgggttttaacgtttttcccgttacctaccgtacccgtaacgtccgtacgtacccgacccgttaacggaacggtaacggtttacgtaaacggttaagtttcgggttacgttaaccgtttacggtttttacgtttccgttaccggtaacccgtagtaaccgtttaagttaaacgtttaaccgtttaaccgtttacggttacccttacgggttacccggttaccggtttaacccggtttaccggggtaaccccggtaaccggggttaacccggttaaccgggttaaccggtaaaccggttaaacccgggtaaaaccggttaaacggttaccgggttaacggtacccggttacggaccccgttaacccgtaacggttttacccgttaccgtttaccgtttaacccg

SEQ ID NO: 213239 - DNA, 705 bp, Homo sapiens
  misc_feature: GYAE6OF02FL4MV.21.27.C05.1.454.CMB.1.raw
  modified_base (423)..(423): a, c, t, g, unknown or other
  misc_feature (423)..(423): n is a, c, g, or t
  modified_base (481)..(481): a, c, t, g, unknown or other
  misc_feature (481)..(481): n is a, c, g, or t
  modified_base (626)..(626): a, c, t, g, unknown or other
  misc_feature (626)..(626): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttccttcccgtgctggcctcccatgggtgtcctgtcacagatcaaactacagcagtctggtccaggacgtggtggacggccctcgctacgtacccctttcacctcacctgtcgacactacgtaccggggtaaatcggtacgctggactaactagtgggttacggtaagttggtattacggccgtacggtccccggtacggacggtacggtccgttaggacggtcggtcgttagggaacggtaccttagttacgtaccgtcccgaggttgtagtcgaagtactagtcgactagtnttcgtgtgtacgtccggtcgtacctacgtaccacgttacccaccccgtagtaaccccnccgtaaccgaaagtaacctcggtaccgtacccttacccctaacctaccttacggtccgttaccttacgaccctacccgtacccgaccggtaccgtaccggtacgtttaggttttttacttcggtacgtaccgaaggtcggttacnccgtacgtacgtttccggacttacccgtccttaccgtagtacccgttccggtagggtacccggtaaggttccgttaccg

SEQ ID NO: 213240 - DNA, 755 bp, Homo sapiens
  misc_feature: GYAE6OF02I1GVU.21.27.C05.1.454.CMB.1.raw
  modified_base (208)..(208): a, c, t, g, unknown or other
  misc_feature (208)..(208): n is a, c, g, or t
  modified_base (410)..(410): a, c, t, g, unknown or other
  misc_feature (410)..(410): n is a, c, g, or t
tcagtcgtcgctcgcacgaccggtgctcgatttagacgcgatcgaagggtttggggggaggaactgctcagttaggacccagacggagccatggaagccccagcgcagcttctcttcctcctgcttctctggctcccagacaccactggagtgattggtgatgacgcagtctccagccaccctgtctgtgtctccgagggggggaccnccgccctacctctccgtgacacgacgcctagtaccgacgtctacgtcgtcgtacgacgttcggttacgtccgtacggtaccgagacgaagtaacgtcgacggaccgacggcctccgacgtccttccctacttacgttccgtctaccgtactaccgacgacggtacctacggtcgtaccgaccgtacgtacgtacggtacggngggtcgggtcggtagggttacggttcgggtaacttagtttaccgtttcctaccgtaccgtaccgtacgtccggacggtacccgtaccgtaacgtacggtaggtacggtacgttacggttaggtacgtacgtttaggtttacttcgtccgtacgtacgtactaaacgttaattaaccgttcggtaccgtccgttcggtacccgttacgggttacccggtaccggtaacccgggtaccgggtaaccgtaacgggttaccgtaaccggtaaaccgtaaaccggttacgggtacggtaccggtaccgtaccggtacctaccggttaccgttacgttaccgttacttccg

SEQ ID NO: 213241 - DNA, 877 bp, Homo sapiens
  misc_feature: GYAE6OF02FLZJA.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgcccaccctctctcgcacacgccagtcagtctatcgctgacgtgggttaacgccttacgggtaccacggtacaaagtaaatccgtgggacccacggggccccttaccccgacgggtcccttccccttaccaacgtttttacccgtcggtacctaccgttaccccgacccggaaacggggttcccctaaccggtttcggggttaccgtaccccccgtaaggttaaaccgttacggggttttaccgtaacgggggttcggggtaccgggggtttaggggttaacgggtttttacggggggaaacgttaaacggggtttaaccgtttttttccgcccttaacctaacccgtaacgttaccgtacggtaccccggtaaccccgtttaacgaacgggtaaacgttacggggtaaaagtacgggtttacggttcgggttaccgtttaagttttttaactttcgttacggtaccgttaacggacttaaattaccgttaaactttacggtaccggttaccggttcgtaccggtttaaccgggttccgggttacccggaaccggggtaaccgggtaaaccggtaacgggttaaccggtaaacggtaaacccgaaaacggttaccgtagggtaccgtcggtacgtacccgaccgttacggttaccgttacgtttccttacccg

SEQ ID NO: 213242 - DNA, 707 bp, Homo sapiens
  misc_feature: GYAE6OF02F8VVH.21.27.C05.1.454.CMB.1.raw
  modified_base (206)..(206): a, c, t, g, unknown or other
  misc_feature (206)..(206): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccgtacctgtctgtcgtctccgagggggggancgccacccgtctccgtgccacacgcctagtccagtctactcgtctgtacgttggttacgccgttacgggtaccaggcaagtaaactcgttcggccaggtcccgtcccgacggtcctccgtacttacgtttaccgngacctactcccgaccgacggcctacgtcggtcctacccngtactaggttcgacgggtcgggacggttggtagtttcggggaactagggttacttttccgcgtacctacgtactcgtaacgccctacccgtaagacggtacgtaggtaagtagttacggttcgacctttaaggttttccttgacgtccgtagtacttaaagttaagttacttaccggtcgttaccgttcggtacggttaccggttaccggtacggggaaccctacggggaacctagggggttaaccaaacgtaacggtaaaaccggtcgtcgggttacgggtacctacggtaccaccgttacgttcccgtacgtttaccttacccgg

SEQ ID NO: 213243 - DNA, 883 bp, Homo sapiens
  misc_feature: GYAE6OF02HUXJK.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccagtgggtgtcctgtcacagtactacaaactacagctagtcgtggtccgaggacgtggtcgacgtccctcgcaccgtaccctttcgacctactaccgtgtacgacctacgttaccggtaaccgggggtaaaattcggtccgaccgtacggaacaaacgtaacgttagggttaggtaagttagggtaagttacggaccgtaccggttcccccgtacggacggtacgggtccgttagggtacggttacggtacggtttacgggtaaaccggtaccgtttaacgttacgttaacccggttccgtaaggttacggggttaactacggtaaacgtaccgttaagtacggtaacgtaacgtaacgtttagtcgggtacgtacgggtacccggttacgttcccgtacctaaccgtaccgtaacccggaaccccgtaaggaaccccgttacgttaaaccgaaaaggaccgtttaccccggaacgttacccgttacccctaaccccgtaaccgtttaagttccgggtaccttacccgtaccttaaccccgggtaccccgaacgtaaccgtaccgggttacctttaacggtttttttttaccgttacgaaccgtaccgtaaagggtacggtaacgtttaacccgacgtttaccggttaccgtaacccggttacccgtttacccggttacctttacgggtacccgtaaccggggttccggggtaccggtaagggtttaccccgg

SEQ ID NO: 213244 - DNA, 795 bp, Homo sapiens
  misc_feature: GYAE6OF02GXKZA.21.27.C05.1.454.CMB.1.raw
  modified_base (201)..(201): a, c, t, g, unknown or other
  misc_feature (201)..(201): n is a, c, g, or t
  modified_base (347)..(347): a, c, t, g, unknown or other
  misc_feature (347)..(347): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattggtgatgacgcagtctcacgccacctgtctgtgtcgtcggagggggnccgccaccctctccgtgacaccacgccagtccagtctagccgctacgacttggtacgccgttacggtaaccaggacaacgtaactcggtcggacctacgggccctacccgacggtcccttcccgtaacgttaccgttttacccggngtacctaaccgtaccccggaaccggtaccgggtacccctaaggttccgggttacccgaaccccgtaaagggtaccggttaacggtttaccggaaggggtcggggttagggttacggggtttaacggttttacggggaaacgtttacggtttttcgtttttaacccaccgttaccctaacccgtgtaccgacccgtacccggtacccttaaggacggttaacggtaacggtaagtaggttccggtttaacgttacggtttagtttttacgttcgtacgtaccgtacgtaaacttaacttaaagttaccttagggtaccggtccgttacggtccgttacggtaccgggttaccggaacgtaaccgggaacgttagggtaacgtaaccggtaacgaaaccgtcgtacggttacgacttaccgactaccgttactcgttaccgttcgtaccc

SEQ ID NO: 213245 - DNA, 838 bp, Homo sapiens
  misc_feature: GYAE6OF02IWCYS.21.27.C05.1.454.CMB.1.raw
  modified_base (129)..(129): a, c, t, g, unknown or other
  misc_feature (129)..(129): n is a, c, g, or t
  modified_base (205)..(205): a, c, t, g, unknown or other
  misc_feature (205)..(205): n is a, c, g, or t
tcagtcgtcgctcgcacgaccggtgctcgatttagacgcgatcgaagggtttgggggaggaactgctcagtttaggacccagacggagaccatggaagcccagcgcagcttctcttcctcctgcgttcnctggctccagacgaccacgtggagtgacttgtgatgacgcagtctcagccacctgtctgtcgtcctcgagggggcncggcccacctctcctgacgacgacgccgagtcgacgttctacgtccgactgtacgttggttacgccgttaggaccaggactaagaacttcgacggcctacgggtcctacccggacggtcccttacctaccgttacgtttaccgcgtacctacctacccgaccggacggtacctacggttcggtacccacccgtaaggaccttaacggttccggaacggggttcgggtacgggttagggtaacgggttttacgggaacgttaacggttttccgtttttaccgaccgttaccctaaccgttagtacccgaaacggtccccgtaaccgtaacggacggttacggtaaggtacgtacggttcgggttacgttaccgttttaacgttttacgtttaccgtcggtacccgttaacgttaccgttaaacggttaaaccgttaacgtttaccggtacggttacccgtaacgggtttccggttaaacccggggtcgtttaaacccgggaaccggttaacccggtaaacgggtaagggttaacccggtaaaacgttaacccgggttaaacgtaacccggttggggtaccctaacggttaccgacccgtaacggttacctaccgtttaccgttacgttacccgg

SEQ ID NO: 213246 - DNA, 629 bp, Homo sapiens
  misc_feature: GYAE6OF02JNPT9.21.27.C05.1.454.CMB.1.raw
  modified_base (177)..(177): a, c, t, g, unknown or other
  misc_feature (177)..(177): n is a, c, g, or t
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
  modified_base (442)..(442): a, c, t, g, unknown or other
  misc_feature (442)..(442): n is a, c, g, or t
  modified_base (620)..(620): a, c, t, g, unknown or other
  misc_feature (620)..(620): n is a, c, g, or t
tcagtcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtcctccagccnccctgtctgtntctccgagggggactccgccacccttntccgtgacacacgcctagtcagtcctagtccgntcgaacttggtacgccttcggtaccagtcaagtaactcgtcggaccgtggccttcccacgggcctccgtactacgtttaccgngcctacnccgacacgggccctagtgggtcctacccgagaccgtgttaccgnggtcgggtcgttcggtacgttacgggnttacgttacgttttcgctacgactactacgacnccgttaccagtaaccgatagacgtagttggtactcgttagtttacttcgacgccgaataccgtattaacgtacgtacgtcggactcggtcgtacgtcggtaccgtcgccggtaacgtcggtaagaccgtaacgaacgttcggacgttcgacgttccggacctaccgtatcccggttanaccgttaac

SEQ ID NO: 213247 - DNA, 1049 bp, Homo sapiens
  misc_feature: GYAE6OF02FTCXX.21.27.C05.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagacgcgatcgaagggtttgggggagaactgctcagttaggacccagacggagccatggaagccccagcgcagcttctcttcctcctgcttctctggctccagacaccactggatgattgtgatgacgcagtctccagccacctgtctagtcgtccgtccggagggggacnccgcccacccttcctacctggaccacgacgccacgtctacgtctactcgctgacgtggttacgccgtacggtaccacgacgaacgtaacgttccgcggacctacgggccctacccgacggccctttccgtacgtacgttttaccggctacctaccgtacccgacggtaccgggacccttacgggttccggtaccgtacccggaaggtaccggtttacggtacggtacggggtcgggtaccgggtttacggttaacggggtttacgggtaccgttaagggtttttacccggtttttaccctacccggtttaaccctaaacccggtaacgttacccggtaaccccgggtacccccggttaaccccgtaaagggttaaaccgggttaaacggggttaacggtaaaaccggggtttacgggttaccggttttaacgggtttaaccggttttaaaccggttttttacccggttttaacccgggttacccgggaaacccgtttaaaccggttaaacccgtttaaaaagtttttaaacccggttttaaaacccggttttaaccggggtttaccggggtttaacccccgtttacggggggtttaacccccgggtttaaccccggggtttaaacccccgggggtttaccccggggttaaacccgggggttaaaacccccggggttaacggggtaaacccggggttttaaaacggtaaaacccggttaaaaccccggggtaaaaaccgggtttcggttaaaccccgggggttccggtaacccgttaacccggtaaccccgtttaacccggttacggtttacccggtttttacccggtaacccttttacccccggg

SEQ ID NO: 213248 - DNA, 789 bp, Homo sapiens
  misc_feature: GYAE6OF02IZOUZ.21.27.C05.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccactggagtgattgtgatgacgcagtctcagccacctgtctgtgtctccgagggggancgccaccctctcctgcacacgccagtcagtctagtcgctgactggttacgccgtaggtaccagccaagtaactcgtcggaccgaggtcctacccgaggtcctccttacgtaacgtttaccggtcgacctactaccccgacgacgggccctacggttcgggtcctaccctaggaaccgttaggttacgtagggttcggggtccgggttagggttacgtttacgggggaactaggttttacggttttcctaccgtacctaacctagtacccgtacggtaccccgtaacccgtaagtaacgggtaacgtaacgggtaaacgttagttccgggtttaagtacccgttttaacggttttttaacgttttaccgtaccggtaacccgtaacggtttaactaaaagttttaaacgtttaaacccgtttacggtacgggtccgttacgggttacccgggttacggtttaccgggttacccggaacccgggtacggggtaaaccctaaggggttaacggaaaaccgttaccggaaaacgtacggttacgggtacgacgttacgaccttaaccgtacttacggttaccgttcttaacccg

SEQ ID NO: 213249 - DNA, 926 bp, Homo sapiens
  misc_feature: GYAE6OF02JFZ9F.21.27.C05.1.454.CMB.1.raw
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcctacctgtctgtcgtcgtccggagggggcnccgccctaccctcctccgtgaccacgtcgaccacgttcagtccttatccgactacgtacgttcggttacgccgttaggtaccgtaganaacgtaactcggtacggccgacggtccctcccgaggtcccttaccctacttacgtttaccgngacctacgtcccgtaaccgcgggtacctacggtcggttaccgtaccgagtaccgttacgtcggagggttggcgggttagtacggtttcggaacgtagtttacgttttccacgtaaccgtactagttaccgaccgtacccgtacccgtaaacgtaacggttacggtaaacggaacgttacgttacggttacggttaacgttttacggtttttaaccttcgttaacccggtaccgtaaacggttttaaaccgttaaagttttaaacccttaaaccgggtttacccgggttacccggtttaccgggttaaccggggtttaccccgggttttaaacccggggtttaacccgggtttaccccgggggttaaaccccgggtaaacccggggggttaaaacctttaaccggggggttaaaccggtttaaaaaccggttacccggggttaaaaaaacccgtttagggggttaacccggtttaaacggggtaacccccgttttaggggtaaacccctttaaaccccgggtttaacgggtttttccccggtttaacccgttttacggttttaaaccccccg

SEQ ID NO: 213250 - DNA, 707 bp, Homo sapiens
  misc_feature: GYAE6OF02HUSI3.21.27.C05.1.454.CMB.1.raw
  modified_base (206)..(206): a, c, t, g, unknown or other
  misc_feature (206)..(206): n is a, c, g, or t
  modified_base (319)..(319): a, c, t, g, unknown or other
  misc_feature (319)..(319): n is a, c, g, or t
  modified_base (429)..(429): a, c, t, g, unknown or other
  misc_feature (429)..(429): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagaccaccactggagtgattgtgatgacgcagtctccagccaccctgtctgtgtctccggaggggggcnccgccaccctctcctgcacacgccagtcagtctagtcgctcgacttggtacgccgtacggtaccagcaagaaatctcggcaggcctcccaggtcctccctatagtttaccggnaccgactacccgacgacgggtacccagttcgggcctcccgaaggtacctaacgggttctagggtcggggtcggtggtaagtttcggggaactagggttacgtttttcccnctaaccacgtacgtcgacggcccgtacccgtaagtaggtacggtagtaacgttacgttaggttcgtactttaagttttacttccgacgtacctaagtaactaaatttaacgttaacgttacccggttcggtaccgtacggtccgggttaccggttaccgggttaccggtacccggggaaccggttaacggaacgggttaacggtaaacgaaaccggttaaacggtacgggtacggtacggttcggacgtaccgaacttcggtttactacgttacctac

SEQ ID NO: 213251 - DNA, 729 bp, Homo sapiens
  misc_feature: GYAE6OF02GJUKE.21.27.C05.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagacgcgatcgaagggtttggggggcagagcctgctgacttctggctgaccagggcagtcaccggagctccagacaatgtctgtctccttcctnatcttcctgcccgtgctcgggcctcccagtggggtgtcctgtcacagatacaaactacagcagtcgtggtaccgaggtacgtggtggaccggccctcgacacgtaccctttcactccacctgtacacacgtcgtaccggggaaatcgtacgctaggacaataagtggttaggaagttggattacggactaccggtcccggtacgaggacggtccgttggaggtcggtcgttaggaacgtacgtagttactaccgtccgtaggttggtaactggtaaacgtactagtgtaacgagttacttcgtaggtacgtacgggtcggttcgttacgtacctaacgtacctacccgaaccccgtacgtaccgtaaccgtaaccgaaacgtaacgtccgtacggttacccctaacccgtccctaaacgttacgtccgtctaccgtaccctaccgtacccgaaccggtaacgccggttaagtttacgttttaacgtttcgtaaggtacgtaacggtacgggtacctacgttacttaggttaaccggtctaacccgttacgttaccggttcggtaccgttcccgggtacgggtacccgtacgggtttaaccgg

SEQ ID NO: 213252 - DNA, 813 bp, Homo sapiens
  misc_feature: GYAE6OF02IQON5.21.27.C05.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccacctgtctgtgtctccgagggggacnccgccaccctctcctgaccacacgccagtcacgtctactcgctacgacgttggttacgccgtaggtaccagcaagaaacgttcgtacggccaacggcctacccggacggtcccttacccttacgttaaccgttttacccggtacgaccctaccgttccccaacccgggtacgggaccccttaacgtttccggggttaccgtacccgaaggtaccggttaacgggttcgacggggttcggggtacgggtttgggttaacggttttacgggaacgttacggtttacgtttttccctccgttacccgtaaccgttacgtaccgtaaccggtccccgtaacccttaacgggacggtaacgttaggtaacgttacggttgttacgtacgtttaggttttaacgtttccgaggttacctagtaactaaacgtttatttaacgttaccgttacgggtaccgttcgggtaccggttaccggtttaccgggtacccggacccgggtaaccggggtaaccggtaacggggtaacgtaaaccggttaaccggaaaccggttaacggtcggttacggtcgtaccggtacctacggttctttaacggtttcctaccgttaccgg

SEQ ID NO: 213253 - DNA, 704 bp, Homo sapiens
  misc_feature: GYAE6OF02JTDXD.21.27.C05.1.454.CMB.1.raw
  modified_base (125)..(125): a, c, t, g, unknown or other
  misc_feature (125)..(125): n is a, c, g, or t
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctcttcctnatctctgccctgctggcctccagtgggntccgtcgtcanagatcaaactcagcagtctcgtccaggactggtcgacggtccctggaccacgtaccctttcactccacctgtacgacncgtaccggacgggaaactcgtcgngtcgacctaacgaagttggtaggtagtggtacgttaggaccgtacgcccgtacggaggtacggccttaggagtgcggttacgaacggtacttaacgtacgtccgtccgtagtcggtactaggaacgtacgtactggacaggttactcgtagtacggaccgtgtccgtactcgactaccgtacctacccaacggtacaccggttacaaacgtagttaacccgcggttcctacccgtaaccacgtaacttcggttacctccgtacgaaccccgtaccgtaacgacccgtaggtttccttttaaacgtttcgtttaacgacggtaaaccgacgttacggacctacgttaccgggttaactcggttaacccttaaccgtttcccggtacgtttacggaaccccggttccgggtaccggggttacccgttaacggtttccggg

SEQ ID NO: 213254 - DNA, 676 bp, Homo sapiens
  misc_feature: GYAE6OF02FLCOB.21.27.C05.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctccagtgggtgtcctgtcacagatcaaactacgagcaggtctggtccaggactgggtcgacggccctcgcacgtaccctttcgacctccgacctgtagactatccgtacggggaaatgtcgcgtggccaagactggttaggaagttggagttacggctacgtcccgngagacggtccttagacggtcggcgttagggaacgtacttagttacgtacgtcccgtagttcggttagtacgtaagacttagtgcgtatactcgtgtagacggtcgtcgtctaccgacctacgtcccaaccgaccgtaacgaccgtaacgaaacgtacgtaccgtacggttaccttacccctaccgtacccttacgttacgttccgtacgtacccgtaccgtaccccgtacgaaccgtaccggtacttagtttcgtttacggtacgtacgtagtaggacttacggtaacttcggttacgtaccgttaccgttacctaccgttccggttaccgtccggtcgggtaccgttacgggttaaccgg

SEQ ID NO: 213255 - DNA, 726 bp, Homo sapiens
  misc_feature: GYAE6OF02H8975.21.27.C05.1.454.CMB.1.raw
  modified_base (199)..(199): a, c, t, g, unknown or other
  misc_feature (199)..(199): n is a, c, g, or t
  modified_base (520)..(520): a, c, t, g, unknown or other
  misc_feature (520)..(520): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctcgcccgtgcgtcgggcccttcccagtgggggtcgtcctgtcacagatacaaactacgagcagttntcggtaccaggtacgtggcggcggtcccctcggacactaccctttcacctacacctgtagacctataccggtaccggggtaaaatcggtccgcgtacggacaacgtaagtggttagtaagttacgtacgttaggccgtacggtcccgtacggaagtcggtccttgacggttcggtagtgggacgtaaccgttagttaactaccggtacctaagggtgttaaacgtgtaaacggtacctagtggacacgtagttagtcggtagacggtccgggtctcgtaccacgtactacccaccgacaacgtacgtaccgaaagttaacncggtaaccgtccgtaccctaccgtacttaacgttgcctaccgtacaacccggttacccgacgtacccggtagtaccttttacggttttaatttcggaagtacgaacgggtagtaccgtacctaacgttaaccggttaggaccgttaacccgtttaacctccggttacggacccttacggggtacccggtaaccgtagggttaaccg

SEQ ID NO: 213256 - DNA, 691 bp, Homo sapiens
  misc_feature: GYAE6OF02HBYTU.21.27.C05.1.454.CMB.1.raw
  modified_base (203)..(203): a, c, t, g, unknown or other
  misc_feature (203)..(203): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgattgtgatgacgctagtctcccagccaccctgtctgtgtctccgagggggnccgcccaccctctcctgccacgagccagtcagttctatcgctgactgttagcctggtaccagcagaatctgcagcnccagctccntacttaccgncatcccgacgtcggccacgtcggtcgacccgagactacggttcaggtcgggcggttagggtagtttaggggactaaggttacgtttttcctacgtaccacctacgtccgacggtcccgaccctaaccgtaggtaacgtaggtaacgtagtttacggtacgtacgtttaacttttacgtttaccttcgtaccgtacgtaaactaaacgttaagtttaaactttacggtaccggtacccttcggttacccggtaccgtttaccgggttcccggacccgtaaccggggaacgttacgggtaaggtaaaccggttaaccgaaaccggttacgttaacgggtacggtacgtaccggtaaccctaccgtacgtttaccgttaccgttacctttaacccg

SEQ ID NO: 213257 - DNA, 703 bp, Homo sapiens
  misc_feature: GYAE6OF02GI8DA.21.27.C05.1.454.CMB.1.raw
  modified_base (205)..(205): a, c, t, g, unknown or other
  misc_feature (205)..(205): n is a, c, g, or t
  modified_base (589)..(589): a, c, t, g, unknown or other
  misc_feature (589)..(589): n is a, c, g, or t
  modified_base (596)..(596): a, c, t, g, unknown or other
  misc_feature (596)..(596): n is a, c, g, or t
  modified_base (679)..(679): a, c, t, g, unknown or other
  misc_feature (679)..(679): n is a, c, g, or t
  modified_base (690)..(690): a, c, t, g, unknown or other
  misc_feature (690)..(690): n is a, c, g, or t
  modified_base (698)..(698): a, c, t, g, unknown or other
  misc_feature (698)..(698): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccaccctgtctgtgtcctccgagggggganccgcccaccctcgtcctgccacgacgccagtcagtctatcgctgacgttggttacgccgtacggtaccagacaagtaaactcgtacggccgtacgggtcccttacccggacggtccccttcccgttacgtaaccgtttttaccccggcgtaccctaaccgttaccccctaacccgggaaccggggtccccgttaaccggttccggggttacccgtacccccgaaggggttaacccggtacggggttttcccgtaacgggggttccggggtaccggggttagggtttaacggtttacgggaacgttaacggtttacggttttcctacggtacaccgtactcgacgtccaccctagaagtcgtagaatcgttgtactcttagtttnttcgcangaactatacttatagtcgtcgtagtccgtctacggtcccggacgacggtaccgagtaagaactaccgaagtacgtggaccgtntcgacctacgntacgtctntaccg

SEQ ID NO: 213258 - DNA, 805 bp, Homo sapiens
  misc_feature: GYAE6OF02HCGAY.21.27.C05.1.454.CMB.1.raw
  modified_base (199)..(199): a, c, t, g, unknown or other
  misc_feature (199)..(199): n is a, c, g, or t
  modified_base (317)..(317): a, c, t, g, unknown or other
  misc_feature (317)..(317): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctccagacaccatggagtgattgtgatgacgcagtctccagcccacctgtctgtgtctcgagggggcncgccaccctctcctgcacgagccagtcagtctagtcgcgtgacttggttacgcctggtaaccagacaagaaactcgtaggacctaaggcctcccgaggcctcctacgtactttaccgngtactactccgaaccgtggaccacgtcggtacctaccgaagtaactacggttacaggtcggggacggttaggttacgtttacggggaacgtaacgttacgtttttccacgttaccgaacctagttaccgaaggtccccgtaacccgtaaacgtaaggtaacggttaacggaaacgtagtttcgggttaagtaccgttaaggtttttacgtttacccgtacgtacccgtaaaggtacctaaaagtttaaacgttaaacgtttaaccccgggttagggtacccctaggggttaacccgttaccgggttaaacccggttacccgggttaacccgggtaaaccgggggtaaaccccgttaaagggggttaaacgggtaaaaccgtaaaccgggtaaaaaccccgttaagggttaaccggtacggggttacccttacggtaaccggaaccccgttaacgtttacccggttaccggtttaacgtttaaccccgg

SEQ ID NO: 213259 - DNA, 743 bp, Homo sapiens
  misc_feature: GYAE6OF02HXKUJ.21.27.C05.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctcgagggggancgccacctctcctgcacacgccagtcagtctatcgctgacttggtacgcctggtaaccatacaagaaatcgtacggccaggcctccccgaggtccctccttacctacgtttaccgngacctacctccccgaaccgacgggtccctacgtcgggtccgtacccgaagtaccgtacggttccgagggttcgggtacgggtaggtacgtttaggggaacgtagttacgttttctacgtacctaccgaatcgacgccctaccctaacgaggtaagtaggaagtagttcggttcgtaacgtttaagttttactttcgtacgtacccgtaagtactaaactttaagttaaacttacggtacggttcccgttacggtacccggttacggttacccgggttaccggacccgggtaaccggggtaaccgtaaggggttaacgtaaaccggtaaccggtaaaaccggttaaccggtacgggttaccggtaccgttaccgggacccgtaacccgttaaggtttacccggtttaccggttacccgtttaacccg

SEQ ID NO: 213260 - DNA, 804 bp, Homo sapiens
  misc_feature: GYAE6OF02JZ9ZB.21.27.C05.1.454.CMB.1.raw
  modified_base (126)..(126): a, c, t, g, unknown or other
  misc_feature (126)..(126): n is a, c, g, or t
  modified_base (751)..(751): a, c, t, g, unknown or other
  misc_feature (751)..(751): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttccantccttcgcgccgtgcgtcggcctcgaggtgggtctcgtcgtcagagtactacaaacgtcagcgtcgtcgtacggaccgaggtgtggcggccgtccgtcggtacaccttacccttacactaccgtacgtcgagaacgttacgtccgggtaacgggtaacgttggtccgtcgtacggaaccgaagtacggttgggtaggttaagtacggtaacggttacggtactaacccgggtcccggtacggtacggaccggttggttaaggtcggttcggtacgggttaaacggacggttaacttacgtaccggtaccgtccggtaggtagtactagggaacttacggtgtacgagttagttacttacggtcggtgtaccggttcgggtaccttaccaccgtaaccgtaccgtaaccccctaacgtaaccgggtaacggtaacccgtaaacggttaaacgtacccggtaccgttaacggtaccccgttacccctaacccgtttacgtacggtttaccgggtacttcccgtaacccggttaaccccggtaaacccggtacgggtacctttacgggttaacttttaacggttttactaggtaccgaggtaacgtacgtatacgtacgtaacggttntaacccgttcttaccgtcgttaccgccgtcgggtacggtaccgttagtacccg

SEQ ID NO: 213261 - DNA, 772 bp, Homo sapiens
  misc_feature: GYAE6OF02HWO74.21.27.C05.1.454.CMB.1.raw
  modified_base (204)..(204): a, c, t, g, unknown or other
  misc_feature (204)..(204): n is a, c, g, or t
  modified_base (257)..(257): a, c, t, g, unknown or other
  misc_feature (257)..(257): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtcgtccgagggggganccgccaccctctcctgcacacgccagtcagtctagtcgctacgacttggtacnccgtggtaaccagacaagaaactcgcggtacacggcctcccgagtccttccgtacttacgtttacgtcactactccccgaacgaccgggacctacggtcggtccgtacccgtacgacgttacggttcgtagggtcgggtacgggttggttaacggtttcgggtaaacgtaggtttacgtttttcccgtacctaccgtacctacgtaccgaccggtccccgtacccgtaagtaacggtacggttaaggaacggtaagtttcggttacgtaacgtttaacgttttactttcgtacgtacctaaagttactaaaacgtttaacttaaacgttaccggtccgttaccgttgggttaccgttaccgggttacccgggttaccggaacccgggtaaccgggtaaccggttaaggggttaaacgtaacccggtaaacggtaaaaccggttagggttaccggtaccggttacgtaccggaccgttaacccgttaactttaccggttaccgttaccgttacccg

SEQ ID NO: 213262 - DNA, 786 bp, Homo sapiens
  misc_feature: GYAE6OF02JT3FZ.21.27.C05.1.454.CMB.1.raw
  modified_base (267)..(267): a, c, t, g, unknown or other
  misc_feature (267)..(267): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgctagtctccagccacccgtgtctgtgtctccggagggggtacgccgaccctaccctccttccgtgaccacctacggaccgtacgtcacggttcttacgtcgtntcggtacgttcggttacgccgttcggtaccgacggactaacgtaaacgtccgtcggaccgacggtccgttacccgttagtccctgtaacttcgtacgtcgtcgttaccggtcccgtacggtaccgggcccttaacggtcggaccgttacccgtaccgtacgtacggttaacgggttacgtgggttcggacgtttacgggtacggggttccgtacggggaccgttacggtaacttcccgtaactcgttacgaacttacggtacttacgacgtagtacgtcggacgttaccgtaggtaaacgttaccgtttcggtacgtacgggttttaccgtattttaaaccggttcgttaacgagttaacggttacgggttagttaaccggtttaccgtacgttcccgttaacgttccggttaccggtacggtacccggtacggtaaccggtaaacggtaaccgtaaggaacgttaaacgggtccgttaaggttccgggtaacgtaccggcccttaacgtagttaccgg

SEQ ID NO: 213263 - DNA, 703 bp, Homo sapiens
  misc_feature: GYAE6OF02JQLPS.21.27.C05.1.454.CMB.1.raw
  modified_base (131)..(131): a, c, t, g, unknown or other
  misc_feature (131)..(131): n is a, c, g, or t
  modified_base (162)..(162): a, c, t, g, unknown or other
  misc_feature (162)..(162): n is a, c, g, or t
  modified_base (575)..(575): a, c, t, g, unknown or other
  misc_feature (575)..(575): n is a, c, g, or t
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctcttcctcatctcngccgtgctggcctccagtgggtctcctgcanagatacgaaaactcgagtcagtcgtggtcagggtactggtgacggcccctagacacgttaccttcgactcactgtcgactacgtcgtaacggaatcgtcgtcgtcgactaacgtagtaggttacggtagtacggtagtacggtcgtaaccgtccccggtaggacgtacggtccgtaggtacggttacggtaccggttagggaaaccgggtaccttttaaagtaaccgttaccggtacccgggtaggttacgggtaatttaaccggaaagttaccgttagttaccgaggtaacgttaagttccggtagggtacgtacggtaccgggttccgttaactacccgtacgtacctacccgaccgtcgaactaccggaactaacgtactacgtcgtaacccttccgacttacgtacgtnacgtctccgtacgtaccncgtacncgttacgttcgttttagtcacggtacacgggtactagtccgaacgttcgtcgttaactccgtaacgttccgtagaccggttccgtacgggaccggttagtaccg

SEQ ID NO: 213264 - DNA, 956 bp, Homo sapiens
  misc_feature: GYAE6OF02GPI11.21.27.C05.1.454.CMB.1.raw
  modified_base (243)..(243): a, c, t, g, unknown or other
  misc_feature (243)..(243): n is a, c, g, or t
  modified_base (860)..(860): a, c, t, g, unknown or other
  misc_feature (860)..(860): n is a, c, g, or t
tcagtcgtcgctcgcacgaccggtgctcgatttagacgcgatcgaagggtttgggggaagaggaagactgacggtcctgccacaggtggtgctgggcacgggtgggccctcgcagccctttcactcacctgtgacgactcgtaccgggaaaatgtcgctggcaacaagtgttaggaattggattaggcagtcccgtcgagaggccttgagtgcttgaaggacctattataccgtccagttagntagaacgtacgtatgccaagtattccttaggtacgaggtccggggttaactccttacaacccgtattacccgaaccccgacggtaacctaacccgttaccgtaaaacgaaaccgttcgtaacgggttccttaacccccgccttaaaccgttaatttaccggttacttcggttacccaccgtttacccggaaccccggttacaaccggggtcctttaaacgggttttttttaattttcggaacgtacccgggtaaaggttaaacgggtaccttaacccgtacgtttaaaccgttgggttaaccgttaaaaccccggtccctttaaacccgtttgggtaaccccgtttcccggttaacgggggacccgtttaacggggtaaaacttttttaccggaacccggttaacccgggttcccttttccgggaccctttaaacccggcccccgggttttaaaccaaacccgggggtaaacccgccccgggttttaaaacccttacccggggggttttccccctttaacccccgggtcgggggttaacccctacccgggttcctttaccccggtaacggtaccggttacccgtacccgtaaccgtaacccgggacgtaccggaacncccggtaacctccccgggggttacgcccgggttcgttacccggacttaccggtaccggtaaacccgttcccgttttaccccgaccgggtagtcccg

SEQ ID NO: 213265 - DNA, 818 bp, Homo sapiens
  misc_feature: GYAE6OF02FXX5W.21.27.C05.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctcagcccaccctgtctgtgtctcggagggggcncgccacctctcctgcacagtccagtcagtctacncgntgacgttggttacgccgtagtaccgngacaacgtaatcgtcggaccgcggtcctacccgaggtccttaccgtcttaacgtttacccggtgtcctaacgttccccaaccgacgggtacccctaggtcgggttccgtaccgagtaacggtacggttacgacggggtgggtccggttagggtacggtttacgggggaacctttaaggggtttccgttttacctacgttaccgtaaaacccgtcgtacccgtacggtcccggtaaccccgttaaaccgtacggttaacggtagggtaaaacggttacgttacgggttacgttacccgtttaggtttttaaccgtttccgttaccggtaccgtaacgtaacctttaaacgttaaacgtttaaccgtttaggttaccggtttcccggttacggttaccgggttaccgggttacccgggttacccggacccgggttaaccggggtaaccgggttaacgggtaacgtaaaccgtaaccggtaaacgtaaccggtaacgggttacggtacgtaccgtaccgtaaccgtacgtttaccggttccttaccgtttacccg

SEQ ID NO: 213266 - DNA, 721 bp, Homo sapiens
  misc_feature: GYAE6OF02IG7LF.21.27.C05.1.454.CMB.1.raw
  modified_base (127)..(127): a, c, t, g, unknown or other
  misc_feature (127)..(127): n is a, c, g, or t
  modified_base (208)..(208): a, c, t, g, unknown or other
  misc_feature (208)..(208): n is a, c, g, or t
  modified_base (377)..(377): a, c, t, g, unknown or other
  misc_feature (377)..(377): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttcnctggctcccagaccaccactggagtgattgtgatgacgcaggtctaccacgcccaccttgtctgtgtctccgagggggganccgccaccctctcctgacacacgccagtcagtctatcgctagtactggtacgccgtacggtaccagcaagaactcgaggccaaggtccaccgagtcctccttacgtacgtttaccgacctaccgtccgacccgcgggaccctacgtggcctaccgacgacgtaggtcgnggtcgggtcggtacggttagttacggggaacttacgggtttactttccgtacgttacccaacgttacgtaccgtaccggcccgtaacccgtagaaacggtacggtacgtaaagtcggttacggtgttaccgtttattttacgttcctggtaaccctaagttaacctagttaaactttaccggttaaggttacccggacgtttaccgggtacggttacccgtacccgggttaccggacccgggtacgggtaaacccgttacggtaaacggtaaccgaaaccgtaaaccggttacggtacgtaccggtacgacggtaccctagtacgtcgtttctaccgttacccg

SEQ ID NO: 213267 - DNA, 722 bp, Homo sapiens
  misc_feature: GYAE6OF02HHR23.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctggcctcccagtgggtgtcctgtcacagatcaaactacagcagtctgtccagactggtcgcgccctgcacgtaccctttcacctcgacctgtacgacagtccgtaccggggtaaaatcgtcgtcgtacggaccaactaagttcgggtaggtaattgggtagttaggccgtaaccgtccccggtacgacggtacggtacccgttaggtacggttcggtcggttagggtaacggtaacccgttaagtttaacgtaccggttacccgtaggttcggttaacgtaggaacgtacgttaacgtcggtaacgtaacgttacgttcgttggtacggtacggtcggttaccgttccgtaccgtaaccgtactaccccacccgtaacgaaccgtaccgtacgaaacgtaataccgacgttaccctcccctacgtaacctagtcgtctaccgtcacccgtaccgccgaacgccgtattacgttttacgtttgacgtacgtaaggacgtcttacgacgtacggttacggtacaccgtttaccgtccgttaccggtccgttaccggtacggggtaccgtacggttaacccgg

SEQ ID NO: 213268 - DNA, 827 bp, Homo sapiens
  misc_feature: GYAE6OF02JQ98K.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctcggcctccagtggggtgtcctgtcacagactacaaactacagcagtctcggtccaaggtactggtggacggcccctcggcctaccgtaccctttcacctcctaccgttggcgaccacgttaccggtaaccggggtaaaagttcgtccgccgttcggacaacgtaacgttggttaggaagtttaggtagttacggtaccgtacggttccccgtcggacggtacggtacgttcggtaggtcgggtcgttagggaacgggtacccttaacgtttacgtaaccgttacccgtaaggttacggttaacgtacggtaaggtaactagttacgtacgtacgttaacttacgtacggtcggtaacgggtcggtaccgtaccgtaccgtaccgtacctaccccgtaaccccgaacgtacccgtaaccgtaacccgaaacgaaacttacgtaccgttaccctaccccgttacctaacccgttaacgttccgttaccgttaccgtacccgttaacccgtaccccggtacgtaacccgtaccgttaccgtttaaccgtttttagttttccgtacgtaaccgtaaggacggtaacgttaccgtaacgtttaccgttacgtacgttaccgttaacccgttttccggtaccttacccggttaccgggtcccgggtaccgggttacgggtttaacccggg

SEQ ID NO: 213269 - DNA, 645 bp, Homo sapiens
  misc_feature: GYAE6OF02FYW5G.21.27.C05.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (310)..(310): a, c, t, g, unknown or other
  misc_feature (310)..(310): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtcctccgacgccacctgtctggtctctccgagggggnccgccaccctctcctgacacacgccacgtacatctancgctgtactggttacgccgtggtaccagcgaacgacgccgtggacccgaggcccttcccgaggttcccncgtacttactacgtggaccgtcggggtacccacggtacgggccctagtcggcacctccgaggtaaccgtggttacgaggtggtcgtacgggttcgggtacgtagggaccacgtacttcctacgtctcgtactacgtataacgctaacggtacgtgtaccgaccgtagaagttacttcgagttgtattaacgttgtacgtgacgacttagtacgtacggttaacttaccgttaccgtcgttcgtacggtcggtaccgaacggtaaccgtaaaggtaacgttaaaacggacgtaaacggtagttacggtcggtaccgtcggaacctacgtacttacg

SEQ ID NO: 213270 - DNA, 807 bp, Homo sapiens
  misc_feature: GYAE6OF02G9JH5.21.27.C05.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtgatgacgcagtctccagccaccctgtctgtgtctccgagggggacncggccaccctctcctgcacacgccagtcagtctatcgntagcgttggtacgccgtggtaccagacaagtaatcctacggacctacggcctcccgaggtcccttacctacttaacgtttaccggtgtacctaccgtacccgaccgacggggtaccctacggttacgggtccgtacccgaagtaccgttacggttacgacgggtggggtaccgggttagggttaacgggtttcggggaaccttaaggggtttaccgttttaccgttaccgtaacccggtaaccctacgtacccgaaccggtccccggtaacccgtaacggtagggtaaacggtaacggaaacggttacggtttcgggtttaacggtcctttaaagggtttttttaaccttccgggtaccgttacggaaacttaccgtttaaatttaacgtttaaaccgtttaccggttccggttaccgttcggttaccggttaccgggtttaacccggtaccggggtaaccgtaaacggggtacccgttaagggaacgtaaaccgttaaccgaaacgggttaccggtagtaccggactccggaacgttccctaggttaccttcggtcttaacccg

SEQ ID NO: 213271 - DNA, 611 bp, Homo sapiens
  misc_feature: GYAE6OF02I6EFP.21.27.C05.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgaccacagccagtcagtctatcgctgactggttagcctggtaccagcagaaatctggccaggcctcccaggcctccgtctacgtttaccggccatcccaccgagggcccagttggctcccagacaggttcaggtggcggtggtagtttgggactaagtcgttttccgctcaaccgtatcagcccgtaccctaagacggtagtacgaagtagttgttacgcttaaggttttatttcgtcgacctagactaagttaataactttacgtcggtaccgtgtcggttacgtacgtttccggaccgtaacggggacctaagggtagtaaaacgtacgaaaaccgtacggttggtacggtaccgtacggaccgaaccttagtccgttacgttccttaaccg

SEQ ID NO: 213272 - DNA, 804 bp, Homo sapiens
  misc_feature: GYAE6OF02HV1R7.21.27.C05.1.454.CMB.1.raw
tcagtcgtcgctcgcacgaccggtgctcgatttagacgcgatcgaagggtttgggggaggaactgctcagttaggacccagacggagccatggaagccccagcgcagcttctcttcctcctgcttctctgctccagacaccactggagtgattgtgagtcgacgacagtcctaccacgccaccctgtctgtcgtacgtcgggagggggacgccgccctaccctctccgtcgcaacgacgccgtagtcacgtactactcgatcgtaacgtcggtagtacccgtcggtaaccacggtacgtaaacggtaacgttccggtcggaccccgtacgggtacccccttacccccgggaacggtcccctttaaccccgttaccggttttaccgttttaacccccggtggtaacccctaccggttaaccccccgaccgggtacccgggtacccgtaccggggttaccgggtaccccgtaacccgtaagggaaccggtttaaccggttcggtaacggggttcggggtaacggggtttcggttaacgggttcgggtaacggttaacgttttaccgtttactacccgttacccgaaaccttccgtaccgtaaccggtccccgtaacccgtaacgttaacggaggttacggaagttaacgttacggtttaacgttacttttacgtttaagttccgtacgtacctagtactaacttaagttacgtacgtacgtcgtcgcgtacgtacggtcgaacgtacggtagacgtaacgaacgaacgaacgtagtcgtagcacgtacgaactctactctacgtcg

SEQ ID NO: 213273 - DNA, 704 bp, Homo sapiens
  misc_feature: GYAE6OF02JZA99.21.27.C05.1.454.CMB.1.raw
  modified_base (126)..(126): a, c, t, g, unknown or other
  misc_feature (126)..(126): n is a, c, g, or t
  modified_base (134)..(134): a, c, t, g, unknown or other
  misc_feature (134)..(134): n is a, c, g, or t
  modified_base (189)..(189): a, c, t, g, unknown or other
  misc_feature (189)..(189): n is a, c, g, or t
  modified_base (562)..(562): a, c, t, g, unknown or other
  misc_feature (562)..(562): n is a, c, g, or t
  modified_base (633)..(633): a, c, t, g, unknown or other
  misc_feature (633)..(633): n is a, c, g, or t
tcagtcgtcgctcgcacgaccggtgctcgatttagacgcgatcgaagggtttgggggcaggagcctgctgacttctggctgaccagggcagtcaccggagctaccagtacaatgtctgtctcttcnactcttcngacgtgcgtcggcctccgagtggggtctcgtagtacactaagtactacgtaaacncgacgctacgtcgttcggtaccaggtcttgggtacgaccggccctagctacgtacctttcgaactccgtacgttggacgtaccgtaggtaccggtaaccggggaaagtcgtcggtaacgtcggactaacgtagttcggtagtaagtcggtatacggctaccggttacccggagacgtacgccgtaggcggtcgtcggtacggacgtacttagttacgtactcgaggttcgtagagtaactaattgacggtactagttagtccgtgggttacgaccgggtttctcgtttaccacgtaccgtactacccggaacctacgtaacgtaaccgtacgaacgtactaccggtcctaccgttcctaccgttactacggtntaccgtacgtaccgtaccgttaccgaacgtaccgtacgttacgtttacgttttcgacggtacgacggttanacggtactcggtacgtagttctacgtactacgttcgtcggtacggtccggtacggtaccgtacgttaccgg

SEQ ID NO: 213274 - DNA, 791 bp, Homo sapiens
  misc_feature: GYAE6OF02JBUQQ.21.27.C05.1.454.CMB.1.raw
  modified_base (161)..(161): a, c, t, g, unknown or other
  misc_feature (161)..(161): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtntcctgtacacagatccaaactacagcagtccgtggtacccgaggtacgtggtacgacggccctcgctacgtaccctttacaccgtccaccgttgtcgacacgtaccggtaaccggggaaaagttcggtccgtacgtacggaccgaactaaggttggttaggtagttaggtagttacggcgtaccggtccccgttcggacggtacggtcgttcggtacggtggtacggttagggaaacggtaccttaagttacgttaccggtaccgtaggtggtaacgtacggtaacggtactagtacgactaaggtaccttacgtggtaggacgggtccggtccgtttacgtccctaacccgacgtacccaaccccgtaacgtacccgtaaccggtaaccgtaaacgtacgtaccgtaccggtaccccgtttaccctaccctaacccgttacgtaccgtttaccgtaccgttaccgtaccctacccggtacccgaacgggttacccggtaccgttttaaccgttttagtttacgtaggtaccgtaggtacggttaactcgtaacgtttacgttacggtaccgttacttacccgtaccttcggtaaccgttcgggtaccgacgggtaccgggtttaaccgg

SEQ ID NO: 213275 - DNA, 689 bp, Homo sapiens
  misc_feature: GYAE6OF02HZM7E.21.27.C05.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (323)..(323): a, c, t, g, unknown or other
  misc_feature (323)..(323): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggatgattgtgatgacgcagtctccagccaccctgtctgtgtctaccgaggggggncgccaccctcgtcctgcacagccagtcagtctancgctagacttggtacnccgtggtaccagctaagaaactcgtggacctaggcctacccgaggacctccgtacttaacgtttaaccgngtacctactccgaacgtacgggaccctacgttcggtccgtaccgagtaccgtacggttcgaggttacgggcggttagtacggtttaggacgtaggtttacgttttctctaccgtactaacgtccgtacggtcctaccccgttaagaacggtaacgttagaaagtttacgttacgttcggtaactttaacggttttactttccggtacgacctaaggactaaagttaacttaacttacggtcggtacgtcggtacgttaccggtacggttaccggaccgtaaccgggaacgtaagggtaaccgtaaactacgaaacgttcgaacggttcgaccgtaccgactaccgtagtacgttccgttacttacg

SEQ ID NO: 213276 - DNA, 823 bp, Homo sapiens
  misc_feature: GYAE6OF02F5HUF.21.27.C05.1.454.CMB.1.raw
  modified_base (205)..(205): a, c, t, g, unknown or other
  misc_feature (205)..(205): n is a, c, g, or t
  modified_base (226)..(226): a, c, t, g, unknown or other
  misc_feature (226)..(226): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagaccaccactggagtgattgtgatgacgcagtctccagccacccttgtctgtgtctccgagggggganccgccaccctcgtcctgcacngaccagtcagtctatcgctgacttggttacgctacggtaccagcgaagaaattcgtggccagggcctacccgacggcctccctgtactttaccgtacgctacctcccgaccgacgggcccacgtagggttccgtacccgaaggtaccgtacggtttacagggtgggaccggggtttagggtacggttttaggggaaccgtaggttttacgttttcccgttacgttaccctaaacccggtacttacccgaaccgggtcccgtaaccccgtaacggaacgggttaaggttccggaaaagttcgggttaggttttacgtacccgttttaaggttttttaacctttccggtaccgtaacccgttagggtaaaccctttaaatttaacgttttaaacttacccgggtacgggttacccgtttcgggtacccggggttttaccgtaacccgggtttacccgggaacccgtaccgggggtaaaccggtaaggtaaccgggtaaaccgttaaacccggaaaccggttaacggttacggggttacccggttagttaccggaaccctaccgttacggtttacccgtttacgttacccgtttaacccg

SEQ ID NO: 213277 - DNA, 747 bp, Homo sapiens
  misc_feature: GYAE6OF02J04BJ.21.27.C05.1.454.CMB.1.raw
tcagtcgtcgctcgcacgaccggtgctcgatttagacgcgatcgaagggttgggggcagagcctgctgacttctggctgaccagggcagtcaccggagctccagacaatgtctgtctccttcctcatcttcctgcccgtgctgggcctcccagtggggtgtcctgtcacagactacaaactacagcagtcgtcggtccaggactggtcgacgccctgactacgtaccctttcacctacctaccgtgtacgactacgtaccggtaacggggtaaatcgtaccgtcgtcggacgaacgtaagtcgggttagtaacgttggtacgttacggcgtaaccggtccccggtacggaggtacggtccgttagggtaaggtcggttacgtacgggtaaccggtacttaagttacgtaacccgtccgtaggtaggtaagtacggtaactacgttaagttggaacctagttacgttcgtaggtcggtaacggtcggtacgttctaccgtaacgtacctacccgaaccgtacggtaactaccgtacgtaaacgtacgtaaccgtaccggtaccctccccgttaacctacccgttagttcgtacgtaccgtacccgtaacccgtccgaaaccgtccgtacgttacggtttaacgttttacttacggacgttaacggaacgtacgtaaccttgtaacttacgttcggtaacctaccgttacctaccgtcgtaccggtacgtcgggtacggtaccgttacg

SEQ ID NO: 213278 - DNA, 842 bp, Homo sapiens
  misc_feature: GYAE6OF02F8VY5.21.27.C05.1.454.CMB.1.raw
  modified_base (161)..(161): a, c, t, g, unknown or other
  misc_feature (161)..(161): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctgggcctcccagtggggtntcctgtcacagatacaaactacagcagtctcggtccaggactggtcgacggtccctgcacgtaccctttcactccacctgtcgacacgttaccgaccgggtaaattcgtcgcgtaggacaacgtaagttggttacggtaagttaggtaagttaggacgtaccggttccccggtacggtaacggtacggtaccgttggacggtggtacgttacgggtaacggtaccgttaacgttacgttaaccggtacccgtagggttacgttaacgtagaaacgtactagtacgactaacggtatttacgtagtacgggtaacggttccggttaccggttcctacccgtaacccgtacgtaccccgtaaaccccgacggtaaacccgtacccggtaaccgtaaaccggtaaccttaccggtaacccggttcccgttaacccccgttaccccttaaaccggttaacgttccggttaccttaccggtaacccgttaacccgtaccccggtaaccgtacccggttaccggtaacgttttacgggtttttacgttttacggtaacgtaaccggtaaggtaccggttacgttaccgtaaggttaccgttacggttaacccggtaaccctttacccgttacgttaaccggtacccgttaccgggtaaccgggtacccggtaacgggtttaacccgg

SEQ ID NO: 213279 - DNA, 838 bp, Homo sapiens
  misc_feature: GYAE6OF02JFHJX.21.27.C05.1.454.CMB.1.raw
  modified_base (139)..(139): a, c, t, g, unknown or other
  misc_feature (139)..(139): n is a, c, g, or t
  modified_base (214)..(214): a, c, t, g, unknown or other
  misc_feature (214)..(214): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccanacacccacgtggagtgattgtgatgacgcagtctccgacgccaccctgttctagtcgtcctaccggacggggganccgcccacccgttctacccgtgccacgacgcctacggtacctacgtactacgtccgacgtgtaccggtttaggttacggccgttaacgggttaaccccaagggtcctaaacggaaaacgttccccggtacgggtacccccgtaaacgggtccccgtacccctaagggtaccccttcccggttacctttaaccggtttttaacccgcggtacccttaccgtaccccgaaccggtaacccggggtaccctaaaccggttcggttacccggaaccctaacgtaacccgtcggtttaaccggaacgggttcggggtacgggttaggttaccgttagggaaccgtagtttaccggttttcacgtccctacccgtagtccgaccgtacccgtaccctacggtaagggccgttaagtaacgacgttacgttagtacgtttaacgtttcgtttacgtaccgacctaagtaccttaagttaacgttacgttaacgtccgggtacttaccggttccgttaccgtaacgggttaccgttaacgggaaccgtacggaggtaacgtaaacgacgtaaacgttggacggtacgtacgtacggtaccgtaactacgtttccgtacggttcttaacccgg

SEQ ID NO: 213280 - DNA, 666 bp, Homo sapiens
  misc_feature: GYAE6OF02GJWSS.21.27.C05.1.454.CMB.1.raw
  modified_base (156)..(156): a, c, t, g, unknown or other
  misc_feature (156)..(156): n is a, c, g, or t
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
  modified_base (258)..(258): a, c, t, g, unknown or other
  misc_feature (258)..(258): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (545)..(545): a, c, t, g, unknown or other
  misc_feature (545)..(545): n is a, c, g, or t
tcagtcgtcgctcgcacgaccggtgctcgatttagacgcgatcgaagggtttgggggaggaactgctcagttaggacccagacggagccatggaagcccagcgcagcttctcttctcctgcttctctcggctccgagacaccactggagtgattgngatgacgctgtctccagccaacctgtctgtattcgacgagggggntccaccgtccttctcgtagccanacgccgtagtcaagtctcgtcggtccaggtaacnggttactccgacggtacacgtagaacgaacgttccgtcgacgtacggctaccggtacgcttacgtcttaaccgttcgtacgactcgacgaaccgtcggaacctcgtggtcccgtanaacgtcgnggtttacgngttcggtggtacgtgtacggacttagtagtttcctacgtcggtaaccttaagccgtagacccggtacaggtacgtaacttggactacgtccgtgtacgttcgtttactcttcggtacacgtaattacgtaacgttaacttacggtcgtacgtcncgttacggtccgttaacggaccggtaggttaacggtacggttaaacgacgtaacggtaaacccgtcgttaacggacggttaccaacggtacccttaggtactacggttcgttactaaccgg

SEQ ID NO: 213281 - DNA, 760 bp, Homo sapiens
  misc_feature: GYAE6OF02JBA9P.21.27.C05.1.454.CMB.1.raw
tcagtcgtcgctcgcacgaccggtgctcgatttagacgcgatcgaagggtttggggcagagcctgctgacttctggctgaccaggcagtcaccggagctccagacaatgtctgtctccttccgtcatcttcctgcccgtgctgggcctcccgagtggggtcgtcctgtcacagactacaaactacagcagtcgtggtacccaggtacctggtcgacggccccttacgctacgtacccttttcaactccgaccttgtacgactacgtccgtaccggggtaaaaattcggtaccgtccgttacgggacctaaacgtaacgttcgggttaacggtaaagtttgggaagtttaacggcctaaccggttccccccggtaaggacggtaacggtcccgtttaggaacgttgggtaccgttaggggaaaccgtaccgttaattacgtaacccgttccggtaggttacggtacgtacggaacgtaaccttagtcgacgtagtacgttcgtggtacgaaggttcggtccgtctaccgtaaccgtactcccgtaacccagaccgtaacgtacctaaaggtacctacggtaccggtcccttacccgtaccgtaacttaacgtcgtaccgtactacccgtaccgttaacccgcgtaaccgaccggtctttaaacgttttgttacgctacgtacgcggtactaccgtacgtacggttcgtacctacctaccgtccgttaacgtccgtacggtaccggtacgtacggtttaccg

SEQ ID NO: 213282 - DNA, 777 bp, Homo sapiens
  misc_feature: GYAE6OF02JIOFN.21.27.C05.1.454.CMB.1.raw
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
tcagtcgtcgctcgcacgaccggtgctcgatttagacgcgatcgaagggtttgggggagaactgctcagttaggacccagacggagccatggaagccccagcgcagcttctcttcctcctgcttctctggctcccagacaccactggagtgattgtgatgcgcagtctcgacgccacctgtctgtgtcncgagggggcncgcctacctcncncncacacgctacgacagtctacgtcgatcgtacgttcggttacncgtacgaccagacgtaacgtacgtcgtacggaccgtacgtcctaccggtacgtccctaccgttacttaaccgttccgcgtacctaccgtacccgtaacccggtacggtacccgtaacggttacggtacccgtacccgtaaggtaccgtttacggttacggacggggtcgggttacgggttacggtttacgggttacggaacgtttacgtttacccgttttccgtacccgtaccgttaccgtaagtcccggtaaccggtcccgttaaccggtaagttaacgggtaacggttacgtaaggttacgttacggttaacgttacgttttacgtttacgtttccgtacgtacttaagtaaactttaaattacgttaaccgttcgttacggtccgttaccgtacggttaccggtaccggttccggaacgggttacggtaaccggtagttaaacggtacgtaaacgtaacggttcggacggtaccgtacgtaccgttaccgtacgtccgtttaccgttacgttacctcg

SEQ ID NO: 213283 - DNA, 749 bp, Homo sapiens
  misc_feature: GYAE6OF02GLEY7.21.27.C05.1.454.CMB.1.raw
  modified_base (713)..(713): a, c, t, g, unknown or other
  misc_feature (713)..(713): n is a, c, g, or t
tcagtcgtcgctcgcacgaccggtgctcgatttagacgcgatcgaagggtttggggagggaactgctcagttaggacccagacggagccatggaagccccagcgcagcttctcttcctcctgcttctctggctccagacaccacgtggagtgattgtggatcgacgcagtcctccacgcctaccgtgtcgtgtcgtcgtaccggagggggacgccgacccaccctcctccgtacgccaccgacgacctacgtacacgtactactcgtcgtaggtaaccccccgttggtaccgtccgtacggtaccgacgacgaaacgtaacgtcgtaccggaccgacggtcccctacccgacggtcccttacccgtaccgttaccgtttccgacgtacctaccgtacccgaaccggtacggtacccgtaaccggttcggtccgtacccgtaaggtaccgtaacggttcgacggtgggtcggtaagggttggttacgggtaacgtacgtttcgtttacgtccgtacgtacctacgtaccgaccgtcccgtacccgtacgtaaggtacgtacgtaacgtagttacgttacgtacgttttggtttaaacttcggtaactcgtagtacctaattaacgttacgtaaccgtcgtacgtcgtacgtacgttccgtaacggacggtaccgtaacggagtaacgtaaacgaccggtaacgtaacgtcgggntacgacgtacctacgtacgttctacgttcgttaacc

SEQ ID NO: 213284 - DNA, 700 bp, Homo sapiens
  misc_feature: GYAE6OF02HLK46.21.27.C05.1.454.CMB.1.raw
  modified_base (208)..(208): a, c, t, g, unknown or other
  misc_feature (208)..(208): n is a, c, g, or t
  modified_base (567)..(567): a, c, t, g, unknown or other
  misc_feature (567)..(567): n is a, c, g, or t
  modified_base (575)..(575): a, c, t, g, unknown or other
  misc_feature (575)..(575): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctcccagacaccactggagtgattgtagatgacgcagtctccagccaccctgtctgtcgtctccggaggggggacnccgcccacccttctccgtgaccacacgccagtcacgtactacgtcgcgtgtacgttggtacgtccgtggtaccgacgacgaaagtaacgtcgtcggacccgtaacggtccttaccccgaacgggtccctttacccgttaccgtttaccggttttaacccggcgtaacccgtaccgtacccccgtaaccggaccgggtaccccgttaacggttccggtaccgtccgaacgtacgtacggttcgagggtgggtacggttggtacgttagggacgttagtttacgtttcacgtaccaactcgtacacggcctaccgagaagtagtacgaagtacgtggtacttacgttagtttactcgtacncgtaatanaattactaattcgtacgtcgtacgtacgtcgtacggtcggaccgtacggtaacgaggtaacgaacgttaaacgaaccggtagtgtacgaccgtcgtaacccgcttaacgtcgttagttacctacc

SEQ ID NO: 213285 - DNA, 844 bp, Homo sapiens
  misc_feature: GYAE6OF02H6WX5.21.27.C05.1.454.CMB.1.raw
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (800)..(800): a, c, t, g, unknown or other
  misc_feature (800)..(800): n is a, c, g, or t
tcagtcgtcgctcgcacgaccggtgctcgatttagacgcgatcgaagggtttgggggaggaactgctcagttaggacccagacggagccatggaagccccagcgcagcttctcttctcctgcttctctggctcccagacaccactcggagtcggattggtgatacggacgtcgacgtctccaggcccaccctgtctcgttcgtactcccggaggggggtaccnccncccgacccttctccggtgaccgaccgttaacggccaggttaccacggttaccttacgtccggtcgttacggaccgtttggttaccgtcccggtacggtaccgaggacgtaaaccggtaacttccggtcggtaaccgacggtaccgtcccggtaacggtccgttaccgttaccgtttacgtttaccggacctaccgtacccgtcctaaacccggggcgtacccgacggttcggttacctacccggtacgttaacgtaccggtttccgaacggttcgggtaacggttacggttacgggttaacggtacggttacggtttaaccggttctttaaacccgtgttaaacccgtaggttacccgtaggtcccgtaaccttaacgggtaccggtagtaacggtagttcggttacggttacggttacgttacgttttaccgtacgtacgtaaccgtacggtaattaaaccgtgtttaaaccgttccgtacgtccggttacgacgggttaccgtcggttcggaacccggttacggaccgttaaggtacgtaccgtaacggtaaccggttacgtacgttaccgnggttaacctacgggtaccttaacgcgtttaccggtacttaccgg

SEQ ID NO: 213286 - DNA, 630 bp, Homo sapiens
  misc_feature: GYAE6OF02HUQJV.21.27.C05.1.454.CMB.1.raw
  modified_base (159)..(159): a, c, t, g, unknown or other
  misc_feature (159)..(159): n is a, c, g, or t
  modified_base (248)..(248): a, c, t, g, unknown or other
  misc_feature (248)..(248): n is a, c, g, or t
  modified_base (457)..(457): a, c, t, g, unknown or other
  misc_feature (457)..(457): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttctcatcttcctgaccgtgctgggcctccgatggggtntcctgtcacagatcaaactacagcagtctggtccaggactgggtgacggccctcgctacgtaccctttcgacctcaccgtgtacgactntccgtacgggaaatcgtcgcgtgacaactaagtcggttaggaattggtattaggctacggtcccgtgagtacggtcgttaggtgtggtcgtaggagtaccttagtagttaccgtaccgtaggtggtagtgaacgtacgtatgacgtagtattcgtgtaggacgtcggtacgttctacactactacccacccgagacctaccgacgtaanactacgtacgtaccctccgtacctacgtactcgtctacgtcgtacctccgacgtacgacggttacttacgttttacgtttcgacgtacgtaacggtacgtctacgtacttacggttcgtaccgtaccttccgtcgttcgtaccgttccggtacggtaccgttaggttacccgg

SEQ ID NO: 213287 - DNA, 855 bp, Homo sapiens
  misc_feature: GYAE6OF02HWLVJ.21.27.C05.1.454.CMB.1.raw
  modified_base (134)..(134): a, c, t, g, unknown or other
  misc_feature (134)..(134): n is a, c, g, or t
  modified_base (160)..(160): a, c, t, g, unknown or other
  misc_feature (160)..(160): n is a, c, g, or t
  modified_base (172)..(172): a, c, t, g, unknown or other
  misc_feature (172)..(172): n is a, c, g, or t
tcagtcgtcgctcgcacgaccggtgctcgatttagacgcgatcgaagggtttgggggcagagcctgctgacttctggctgaccagggcagtcaccggagctccagacaatgtctgtctccttcctcattcttcngcccgtgctgggcctccagtggggtntcctgtcacagntacaaactacagcagtctggtccaggtactggtagacggtccctacgcgacgtaccctttagactcaccgtagtcgtactacgtccgtacggggtaaatcggtacgtcgtacggactaacgtaagtgggtttaggtagttaggtacgttacggccgtacggttccccgtacggaacggtaacggtccgtttaggagttacgggtacggtttagggtaacgtaacccgttagttaacgttacccggtacccgtaaggttacgggttaacgtacggtaaacggtaacttacggtacggtaactaacggttaacgtttccggttacggtacggtacgggtcccggggtttaccgttcccgttaccggaaacctacccgggttaccctaaacccccgtaggtaaacccgtaaccggttaacccgtaaaaggtaaccttaccgggtaaccggttacccctttacccccggttcctaaaacccggtttaaacgtccgggtttaccttaccgttacccgtaaccgtacccggtaaccgtaccggtaccgttaccgtaacgtttttttcgttaggtactacggtacggtacgtcgtaaccgtcgttaccggtttaacgtaccgttaaccttacccggttacgttacgtacccggttaccggtacgggtacccggtttaggtttaaccccgg

SEQ ID NO: 213288 - DNA, 816 bp, Homo sapiens
  misc_feature: GYAE6OF02H4EKQ.21.27.C05.1.454.CMB.1.raw
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (357)..(357): a, c, t, g, unknown or other
  misc_feature (357)..(357): n is a, c, g, or t
  modified_base (391)..(391): a, c, t, g, unknown or other
  misc_feature (391)..(391): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggagtgtattgtgatgacgcagtctccagccaccctgtctgtcgtccgtccggaggggggtacnccgccctaccttcgtcctgccacgtacgacctagtacgtacgttctacgtccggtntacgtaccgttagggttacgtccgttgggtaaccctaaggccgtaaaggaaaccgttcggtacgggaccccgtacggtacccctacccggnggtacccctttccgtacctttaacgtttaccggngtaccctactccccgaaccgacgggtcccacggttcggaccgttacccgagtaccggtacggttacgaggggttcggtacgggtaggtttacggtacgggacttacgggttttctttaccgtacctacctaaccgtcgtaccgacgtacccgtacccgtacggtaacggtacgtaagtacggttagttcggttaaccgttaggttttaacgtttaccgtttccgtacgtaaccgttaacgtaacttaagttaaactaccgtttacggttcgtacccgtagggtacccgttaaccgggtcccgggttaacgggacccccgggttaagggtaacccggtaaacgggttacgtaaccgtaaaggaaaccggttcgtaaggtccgtacgaccgttaccgtaaccttacgttcgttcgttacccttaccg

SEQ ID NO: 213289 - DNA, 930 bp, Homo sapiens
  misc_feature: GYAE6OF02FTSRZ.21.27.C05.1.454.CMB.1.raw
  modified_base (293)..(293): a, c, t, g, unknown or other
  misc_feature (293)..(293): n is a, c, g, or t
  modified_base (888)..(888): a, c, t, g, unknown or other
  misc_feature (888)..(888): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttactctggcctcccagacaccactggagtgattgtgatggacgcagttcctccacgcccaccctgttcctgtcgttccgtaccggagggggggtactccggaccctacccttccttccgtcggaccacacggcccaggttcagtctagtcgctaggacgttaggttacnccttagggtaccagaccgtaaggtaaacttcgtcggaccgtaacgggtccctacccggacggtccttaccccggtagttaaccgtttttaccgggtcaccgttaacctaccccggaacccggtacggggtacccctaacggtttcgggtaccccggttaccccgaaaggtacccggttagggttacccgtagggtcggggggtaccggtttagggtttaaaccggttttggggggaaaccttagggttttaccggttttttaccctaccgttaaccctaaccggtttaagtcccgggtaccggtacccgtaacccccggttaaacggtaagggtaccggttaaacgggtaggttacggttaccgggttacggtaccggtttaacgtttttaacgttttaccggaccggaacccgttaacgggtaaacctttaaaggttaaacgttttaaccggaccgggtttacggtccctttcggggttacccggtttacccggggttaaccggttaccgggaaccggttaacggggttaaccgtagggggtaacctaaaccgtaaaccggttaaaccggaccgttgggtaccgggctttaacncccgtaaccgtttaacgtcccgtttaagtcccgtttaaccgg

SEQ ID NO: 213290 - DNA, 715 bp, Homo sapiens
  misc_feature: GYAE6OF02IZHX9.21.27.C05.1.454.CMB.1.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (698)..(698): a, c, t, g, unknown or other
  misc_feature (698)..(698): n is a, c, g, or t
tcagtcgtcgctcgcacgaccggtgctcgatttagacgcgatcgaagggtttgggggaggaactgctcagtttaggacccagacggagccatggaagccccagcgcagcttctcttcctcctgcttctctggctccagacaccaacgtggagtgattgtgatgacgcagtctccagcccaccgtgtctgtagtccgtccgaggggganccgcccacctcctcgtncaccncgaccngtactacgtctagtcgctaggtacgttggttacgtccgtacggtaaccagaccaagtaaaacgttccgtacggccgtaaccggccgttacccgacggtccttacctacgtacgtttaccggtgacaccgtccgaaccgacggcccgtagtggtaccgtaccgagacgttacgtcgtaaggtcggtacggtacggtagttacgggatacggttcgtttctaccttactacctacgtcgacggtcccgtaccgtaacgtaggtaaccggtagtaaagtcgttaaggttacgtcgttaagttttcgttcgtaacgtaccacggtaactaaattacgttaaccttaacgttcggtaccgttacggttaccggtccggttaacccggttaccgggaaccgaaccgggtaaccgtaagggtaccgtaacgtaaccgtaaacgtacgtaggttaccgagtacgacctanctgttactcccttaacg

SEQ ID NO: 213291 - DNA, 812 bp, Homo sapiens
  misc_feature: GYAE6OF02JSQJF.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatcttcctgcccgtgctcgggcctcccagtggggtcgtcctgtcacagatacaaactacgagcagtcgtggtccaggacttgggcgacggccctggactacgtaccctttcactcacctgtacgactacgtccgtaccggggtaaaatcgtccgtcgtggaccaaacgtacgtgggttacggtaagttgggtaacgttacgggaccgtaccggttaccccggtcggaacggtacggtcccttaggaggttacggtcggttaacgggaaccggtaacttaacgttacgtaacccggtcccgtaagggttacggtaagtaacggtaaagtacgttaagtcgtaccgtaacgttacttcggtagtacgggacgtaccgggtccgtctaccgacccgtactcccgaacctaccgaaccgtacgtaaccgaacgtaacgtaccgtacggtcccttacccgaccttaaaccgtacgttaccgttacgtaccggtactaaccccggttacccaaccgggtaacccgacggttaccgtttaagtttttaccgtttcggtaaaccgtacgtaacggtacggtaactaccggtaacgttacggttaccgggttaaaccgttaccgttacccgtttacggttacgtacccgggtttaaccggtccggggttaacccgtaacggggttttaaacccgg

SEQ ID NO: 213292 - DNA, 879 bp, Homo sapiens
  misc_feature: GYAE6OF02GGXX0.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttctcatccttcctgcccgtgctgggcctccagtggggtgtcctgtcacagatacaaactacagctagtctggtaccaggtacgtggtcgacggcctcgcaccgtcctttcactccacgtgtacgactcgtaccgtaccgggaaatcggtcgctacggactaacgagttacgggttaggtaaagttagggtaacgttacggacgtaccggttccccggtacgaaggacggttccgtagggtaggttcggtacgttcgggaaacggttaccttaagttacgtaaccgttccgtaaggttacggtaagttacgaaagttaactaggttacggacttaacggtacttcgttaggttacggtaccggttacgggttaccgttaccgtacccgtaacccgttacccgttaaccccgaaaccccggttaaacgggtaacccccgttaacggggtaaaccctaaaacggggtttaaccctacccgggtaccccggttttacccctacccccggttaaaccgttaaaccccgtttaaacgttccggttaccgtaccggttacccgttacccggaaccccgtaaaccgtaccgggtaacccggttacgtttttaacgttttttacggtttaaccgtaccggttaaagtaaccggggtacgggttaactacgggttaaccgttaacggttaccgggttacccgtaaccgtttacctttcgtacccgtacccggttccgggtacccggggtacggttaccggtttaccgg

SEQ ID NO: 213293 - DNA, 833 bp, Homo sapiens
  misc_feature: GYAE6OF02JNC08.21.27.C05.1.454.CMB.1.raw
  modified_base (207)..(207): a, c, t, g, unknown or other
  misc_feature (207)..(207): n is a, c, g, or t
  modified_base (375)..(375): a, c, t, g, unknown or other
  misc_feature (375)..(375): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagcccacctgtctgtgtcctaccggaggggggacnccggacccgtacccctccttccgtacgccaccgacgcctaacgtcaacgtcctacgtccgctacgtacttagggttacgccgttaggacccgaggaccaagtaacttccggtacggccgaacggtccctacccgtaggcccttaccgtaccgttaacgtttacccggngacctactaccccgacgacgggacctacggtggttaccgcccgagtaccgtacggttaccaggtcggggcggttacggtaaggtttacgggggaacttacggtttaccgttttccgtaccgttacccgtaaaccgtacgtacggaaccgtacccggtaccccgtaacggtaacgtacgggttaacggtaagttacggttacggttaccggtagtttaaccggtttttcgttaccggtacgtaacccgtagttaaccgtaaacttaaacgtttaaccttaccggttcggacccggtttagaccggtttaccggtacggttacccggaacccggtaacgggtacccggtaaacgggttaacggtaaacgttaaccgggtaaaacgtacggttaacgggtaccgttaaccggttaccggtaaccctaccggttactttaccggtaccgtttcgttaacccg

SEQ ID NO: 213294 - DNA, 714 bp, Homo sapiens
  misc_feature: GYAE6OF02FS55I.21.27.C05.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagtcgtcgctcgcacgaccggtgctcgatttagacgcgatcgaagggtttgggggaggaactgctcagttaggacccagacgtagccatggaagccccagcgcagcttctcttcctcctgcttctctggctcccagacaccactggagtgattgtgatgacgcagtctccacgccaccctgtctgtgtcgtccgagggggganccgcctaccctctcctgcacacgccagtcagtctagtcnctgacgtggttacgccgtcggtaccagcaagaaactcgtcggccacggcctcccgaggcctcctactacgtttacccgtgccactcccgaccgacgggcctacggtggtccgtacccagactacggttacgagggttcgggtcggtagggttacggttacgggaactggttaacgttttcgtcctactaccctagtacctacgcccgtacccgtacgaaggtacgtacgtaaggtattacggttgaccgtttaggttttacttaccgttcgtacctaacgtaactaaatttaagtttaaccttaccggttacggttcccgttaggtacccggttcgggttaacccgttccgggaacccggtaacggggtaaccgaaggggtaacgtaaaccgtaacggtaaacccgtaaggttacgggtaccgtacgtcggtacctaaccggttattcccgttacggtttaccttacccg

SEQ ID NO: 213295 - DNA, 663 bp, Homo sapiens
  misc_feature: GYAE6OF02GLY9F.21.27.C05.1.454.CMB.1.raw
  modified_base (332)..(332): a, c, t, g, unknown or other
  misc_feature (332)..(332): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccggaggggggtaccgcccaccctctccgtgccgactacgccagtcagtctatcgctgacgttggttacgccgtacggtaccagacaagtaaactcgtacggacacggtcctacccgaggcctacctcgtaacgtttccgngcactacccgacgacgggtacctacgtcgtacggtacccagtaccgtacggttcgaggtcggtacggtaggttacggttggaacgtagttacgtttcgctaccgacgtactcgacgtccctacccgtagaagtcgtaagagtagttcggtatacttagttttacttcgatccgtaagtaccctaaagttactaagttaccgtggtaccgtaggtacccgttacggtaccggtccgggaaaccgttacgggaacggtaagggtaacgtaacgtaacggtaaacgtacggttggacgacgttagacccgtcacgttccggttgtaccttaccg

SEQ ID NO: 213296 - DNA, 775 bp, Homo sapiens
  misc_feature: GYAE6OF02FE0A9.21.27.C05.1.454.CMB.1.raw
tcagtcgtcgctcgcacgaccggtgctcgatttagacgcgatcgaagggtttgggggcagagcctgctgacttctggctgaccagggcagtcaccggagctccagacaatgtctgtctccttcctcatctcctgcccgtgctgggcctcccagtggggtacgtcctgtcactagatacaaactacagcagtctggtccaggtactggtgacggccctccgcacggacccttttcacgtcacctgtcgactagtcgtaccgggggaaaatcggtcgcgtcgggacctaacaacgttggttacggaagtttgggaacgtttagggtcctaacgttccccggtcggtaacgtacgggtaccctttgaacggtagggttccgttagggaacggtaccttaagttactaccggtaccgacggttggttactagaacgtacttaacgtggcctaaggtacgttactggggttcgtacggtaccggggttactcgtacccgtaaccgtacgttacccaaaccccacggtaaacccgtaccggtaacccctaaagggtaaccgtacccgaagggtttcccaaccccgttacccgtaaacccttaacggtttctaacccgtttcggtaccgtttaccaccccgggttaaccaccgttaccggggtcttttaacgggtttactttttacggacgtaacgggtaccgtagtacctacgtagttccggtactaccgttacttacccgtagacccttccggtcgggtacccgagggttctttaaccgg

SEQ ID NO: 213297 - DNA, 767 bp, Homo sapiens
  misc_feature: GYAE6OF02ICEPS.21.27.C05.1.454.CMB.1.raw
  modified_base (130)..(130): a, c, t, g, unknown or other
  misc_feature (130)..(130): n is a, c, g, or t
  modified_base (250)..(250): a, c, t, g, unknown or other
  misc_feature (250)..(250): n is a, c, g, or t
  modified_base (344)..(344): a, c, t, g, unknown or other
  misc_feature (344)..(344): n is a, c, g, or t
  modified_base (471)..(471): a, c, t, g, unknown or other
  misc_feature (471)..(471): n is a, c, g, or t
tcagtcgtcgctcgcacgaccggtgctcgatttagacgcgatcgaagggtttgggggaggaactgctacagttaggacccagacggagccatcggaagccccagcgcagccttctcttcctcctgcttcnctggctcccagtacaccactggagtgagttgtgagtgacgctagtctccagccacctgtctgtgtctcgagggggaccgtccaccgtcgtcctggacacacgccaggtacagtctatcgngtgtacgtgtagccgtagtacctagtacgtataaacgtcgtcggaccgacggtccttacccgaaggtcccttacctaccgtacgttttaccggngacctaacgtccccgtaacgtacgggtaccctaacggtcggtcgtaacccgaacgtaccgttaacggttccacggtacgggtacggtacggttaacggtttacgggaaccttaggttacgttttacncccgttaccggaaacctaacgttacgaacgtcccgtaaccctaacgtacggtaacgtaaggttaagagtttaacggtccgtagtttaacgtttactttaccgtaaacgtccgtaacggtaaacttaaacgttaacgttaaaccgttaacggttccgtaaccgttacggtcgttaaccggttaccgggttaccggaaccggttaaacggaccgttaaagggtaacggtaaactacggtaaaacgttcgttaggacgttacgtacgtacctacggaaccttcggtacttaccgttacg

SEQ ID NO: 213298 - DNA, 859 bp, Homo sapiens
  misc_feature: GYAE6OF02JX3IA.21.27.C05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagacgcgatcgaagggtttgggggaggaactgctcagttaggacccagacggagccatggaagccccagcgcagcttctcttcctcctgcttctctggcctccagacaccactggacgtgacttgtgatgacgctagtctccagcctaccctgtctggtcgtccgtaccggaggggggacnccgaccctacccgtctccgtcgaccacgacgcctacgtcacgtactacgtcgcgtacgtacgttggttacgccgttacggtaaccaggtacaaaggttaaactccggtacggacccgtacgggccctacccgacggtaccctcgtaccgttaacgttttacccggcgtacctaaccgtaccccgaaccgggtaccgggtacccgtacgttcgggtcccgtaacccggaacgttaaccggtacgggttaccgagggttcgggtacgggttacggttacggtttaaacggggacttacgggtttaccggtttttccacccgttaaccgtaaccgtacgtaccggtacgtacccgtaaccccgtaagtaacgggtacggttaacggtaacgttacggttacggttacgtaacgtttacgtttaccgtttacgtaccgtaccgaacgttaacgtaacgtttaaacgttaacgtttaccgtaccggtaccgttacgggttaaccgttaccgggttaaccggtaccggtaaccgggtaacgggttaacccgtaagggtaaccgtaaacggtaaccgtaaaccggtaacggtaccggtacgttaccggtaacgccgttaaccgtacgttacggttaccgttccggttaaccg

SEQ ID NO: 213299 - DNA, 761 bp, Homo sapiens
  misc_feature: GYAE6OF02GZN7E.21.27.C05.1.454.CMB.1.raw
  modified_base (691)..(691): a, c, t, g, unknown or other
  misc_feature (691)..(691): n is a, c, g, or t
tcagtcgtcgctcgcacgaccggtgctcgatttagacgcgatcgaagggtttggggggaagaggaagactgacggtcctgccacaggtggtgctgggcacggtgggccctcgcagaccctttcactccacctgtgacatctccggggaaaatgtcgctggcaacaatggttggaattggattaggcagtccccgtgagagccttgagtggcttggaaggacctattatacgtccagtgtatgaagtactatgcagattctgtgagcggtacgtctacaccatccacccagaccacgtacaagaatcgtagtcctccctaccactatcgtctctcaccgccgacgacgcgtactgttttatttcgagcgaaggaggactacacgtagtttcggtactaccttacccttccgttacgtaccttccggggtacggggacccgttaaaggggttaacgttttccgacccgttaccgttcccttccctaaccggtaccgtcccctaacccggtaccggaaaccccgggtcccttagggtcccccggtttacccgttcccccggtcgggcccccggttaacccgtccgtccccgttacccgggacggggttaaccccacccgggtaacccgttaacccgggagtaccggtacccggtaaccgtacccgggggcccccgttcggggacccgggttacnccgggttacccgtaacgggtaaccgaccccggtttaaccggtaacccgttcccggaacccggtacccggg

SEQ ID NO: 213300 - DNA, 606 bp, Homo sapiens
  misc_feature: GYAE6OF01DSEXS.30.19.B08.1.454.CMB.1.raw
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (582)..(582): a, c, t, g, unknown or other
  misc_feature (582)..(582): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
tcagcacgctacgtcacgaccggtgctcgatttagtgagtcagtaagggtaagggggtcggtggagtgggatttcgatatattagtgcgtggtgctaacgtaccccatgaagtacgccagggactcctgtgagggccgagttcaccgagtttccacgggacgacgccaagaaatcaggtatatctaaccaaatgacgtagcccttcgagagacgaggaccacgggctagtgtattactcgtagcgggccggggtagcccgactacgggaccaaccctactaccaagaccttacttaggggccaagggaaccctaggtcgaccggtcctaccgtccgaccgacctccaaccaaagggccccaatcggtccttccccgtcggcaccctccttccaagaagcgaccctactcgggggactacagcgacgcccgtggggctcggccgtggtcaaggtacctacgttccacgtaacgcgttgacttagacgtcggggactagggacgaaagggtcgttacaattacgtntacncanananatanatgtcgacgagacganacanaanacagagngngngacgactanctctctctactctccacnctntgc

SEQ ID NO: 213301 - DNA, 753 bp, Homo sapiens
  misc_feature: GYAE6OF01AD5FU.30.19.B08.1.454.CMB.1.raw
  modified_base (648)..(648): a, c, t, g, unknown or other
  misc_feature (648)..(648): n is a, c, g, or t
  modified_base (675)..(675): a, c, t, g, unknown or other
  misc_feature (675)..(675): n is a, c, g, or t
tcagcacgctacgtcacgaccggtgctcgatttagtgagtcagtagggtaggggtcggtggagtggatttcatattagttacgtgcgtacggtgcgtaacctaccatgaaggtaccgtcagtaccttccttgtcgtaacggggcccgagtttccacccattttacccaacggggaccgaacggacctaaaggtaaattccgaacgtactaattcctaaccaaagttcgacgttagcccttggacgacgacgggaaggaccaccggtcctgtcgtattaccgtggtcgcggggccggggagccctagtcggaccacccgtacaccgaagaccgttacgcggggtaccgaacgggaaccctgggttaccgacccggttccgtaccctccgaccggtcccctaccgacccgtaacggggcccctacgttccgggttttcccgttcccccgcggccaccccctcccgtacccgaaacggtaccgctacccgtcggtacgggggccaacgacggtccgtacggcccgtggggccttcggccctagggtaccgaacggtacctttacctttcccgaccgttacggcgtccgtacgtcggaaccggcgggtaccgtgggaccgacggtacggactacggttacgacgtctagtcngacctgctgagtcaacggttcttccgngtcgtactcgggacgcggtcgtcgagtacgtacgtacgtacgacgtcgtcgtcgacgtacgactacgtctcgtcgtcg

SEQ ID NO: 213302 - DNA, 189 bp, Homo sapiens
  misc_feature: GYAE6OF01BR7YZ.30.19.B08.1.454.CMB.1.raw
  modified_base (88)..(88): a, c, t, g, unknown or other
  misc_feature (88)..(88): n is a, c, g, or t
  modified_base (154)..(154): a, c, t, g, unknown or other
  misc_feature (154)..(154): n is a, c, g, or t
  modified_base (156)..(189): a, c, t, g, unknown or other
  misc_feature (156)..(189): n is a, c, g, or t
tcagcacgctacgtcacgaccggtgctcgatttagtgagtcagtaaagggaaagggaccaaggtggaaatcaaacgaactgtggctgnaccatctgtcttcatcttcccgccatcctgatatagatcgctgagcgggctggcaaggcgcatagnannnnnnnnnnnnnnnnnnnnnnnnnnnnnnnnnn

SEQ ID NO: 213303 - DNA, 799 bp, Homo sapiens
  misc_feature: GYAE6OF01EZ7D2.30.19.B08.1.454.CMB.1.raw
  modified_base (708)..(708): a, c, t, g, unknown or other
  misc_feature (708)..(708): n is a, c, g, or t
  modified_base (744)..(744): a, c, t, g, unknown or other
  misc_feature (744)..(744): n is a, c, g, or t
  modified_base (760)..(760): a, c, t, g, unknown or other
  misc_feature (760)..(760): n is a, c, g, or t
tcagcacgctacgtcacgaccggtgctcgattttagtgagtcagtaagggacgggcgtggaggtggagtttcactatattagtggcttcggtgcttacctacctagtgaagtacgcagactctagtgaggggccgattcacccatttccgagggtacgacgtccaagaaattcgtacgttattacttactttaaacgaaatcgagtagcctggagagacggaggacgacgggctggttggtaagtttaaccttggtacggccgggggaccggggggacgggtcccctacgtaccgggaacccctaccccttacctaccgtaagggtacctttacggtcggggggtacccgaacggggtaaccccccgttcggggttcccggcccggttaccccttaccccgtttccgaacgggccccgttccggtaaccccggtaaccggggcccccctaggttccccgggttccccgtttacccccgggtgggggcccctaccccggtttccgtacccggaacgtacggacctacccgttcggtacgggggccaccgtacggccgacggccccggtcgggaactccggacccgttacgggtaccaaacggtacctttacccgttaccgaacggtacggtcccgtagtcccgtacggacggccgggtacgtacggacccgtaacggccgaacgtaactacggcctcgtacctatagtnaactcgccgcgacgacgcgacgacgacgagtgtatntgtgcgacgcgtcganacacactactacgtacgtacggacgacggtcgtcgtccg

SEQ ID NO: 213304 - DNA, 605 bp, Homo sapiens
  misc_feature: GYAE6OF01A7GOP.30.19.B08.1.454.CMB.1.raw
  modified_base (349)..(349): a, c, t, g, unknown or other
  misc_feature (349)..(349): n is a, c, g, or t
  modified_base (562)..(562): a, c, t, g, unknown or other
  misc_feature (562)..(562): n is a, c, g, or t
  modified_base (566)..(570): a, c, t, g, unknown or other
  misc_feature (566)..(570): n is a, c, g, or t
  modified_base (573)..(574): a, c, t, g, unknown or other
  misc_feature (573)..(574): n is a, c, g, or t
  modified_base (576)..(577): a, c, t, g, unknown or other
  misc_feature (576)..(577): n is a, c, g, or t
  modified_base (579)..(583): a, c, t, g, unknown or other
  misc_feature (579)..(583): n is a, c, g, or t
  modified_base (585)..(590): a, c, t, g, unknown or other
  misc_feature (585)..(590): n is a, c, g, or t
  modified_base (593)..(605): a, c, t, g, unknown or other
  misc_feature (593)..(605): n is a, c, g, or t
tcagcacgctacgtcacgaccggtgctcgatttagtgagtcagtaaagggaaggggctgggagtggatttcatatattagtgctggtgctactaccatgaagtacgcagactctgtgaggggccgattcaccatttccagggacgacgccaagaaatcagtatatctaacaaatgagtagcctgagagacgaggacacggctgtgtattactggtgcggggcggggacgccacgtcggacccaccctacaccaagactacgtggggaccacgggaaccctggtccgccgtcctccctcacgtcctccacccgaacgggccccacgtccggtccttccccctcggacccncccctccctaccgaacgacgcccacccgttccggtacggggggccacgacgccgaaccggtcccgtgggccttcgtcccgttcgggtaccaaacggaaccttaccccgtttacccgaacggttcggaccggtcggttcgttacggggacccggggtgggggccgttacggggacccggtaaacggggccgtacccgaaagttaacggcgacgngcgnnnnngcnncnncnnnnncnnnnnngcnnnnnnnnnnnnn

SEQ ID NO: 213305 - DNA, 667 bp, Homo sapiens
  misc_feature: GYAE6OF01AXE82.30.19.B08.1.454.CMB.1.raw
  modified_base (190)..(190): a, c, t, g, unknown or other
  misc_feature (190)..(190): n is a, c, g, or t
  modified_base (599)..(599): a, c, t, g, unknown or other
  misc_feature (599)..(599): n is a, c, g, or t
  modified_base (609)..(609): a, c, t, g, unknown or other
  misc_feature (609)..(609): n is a, c, g, or t
  modified_base (612)..(612): a, c, t, g, unknown or other
  misc_feature (612)..(612): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
  modified_base (651)..(651): a, c, t, g, unknown or other
  misc_feature (651)..(651): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
  modified_base (659)..(660): a, c, t, g, unknown or other
  misc_feature (659)..(660): n is a, c, g, or t
  modified_base (662)..(662): a, c, t, g, unknown or other
  misc_feature (662)..(662): n is a, c, g, or t
  modified_base (665)..(665): a, c, t, g, unknown or other
  misc_feature (665)..(665): n is a, c, g, or t
tcagcacgctacgtcacgaccggtgctcgatttagtgagtcagtaagggtaaggggtcgtggagtggactttcagtatattagtgctggtgctactaccgactgaagtacgcagacttcgtgtgagggccattcacactttccgagggacgacgccaagaatcagtatatcacaatgacgtagcctgagngacgtagacacggctgtcgtattacgtggtacgccggggaccggggtcaccaccgttcggaaccctaaccccgtacacccgaaggtaccttacggacggggaccgaacgggtaacccgtcggtccgtacccggttaccttaccgtccgtacgtcccgtaaccgaccccgaaaccgggaccccaacggttaccccgggttcccttcccccgtacggcccctaccccgttcctacccaacgtacggacctaccgtccggtcggggacacgtacgaccgcgccgtacggctcgccgtcggtacgtaacggtacctaccgttacgtacgtacggtacggtacgtcgtaggtacggtaccggacgttacggaacggacggaccgaactacggtaacgtgtaccgtgacgacgtnacacacgcgngangagtgtactctncnctntcgcgcgacgngtanacgcgcngacncncnncncgngc

SEQ ID NO: 213306 - DNA, 554 bp, Homo sapiens
  misc_feature: GYAE6OF01BZUW1.30.19.B08.1.454.CMB.1.raw
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (510)..(511): a, c, t, g, unknown or other
  misc_feature (510)..(511): n is a, c, g, or t
  modified_base (519)..(521): a, c, t, g, unknown or other
  misc_feature (519)..(521): n is a, c, g, or t
  modified_base (526)..(526): a, c, t, g, unknown or other
  misc_feature (526)..(526): n is a, c, g, or t
  modified_base (528)..(530): a, c, t, g, unknown or other
  misc_feature (528)..(530): n is a, c, g, or t
  modified_base (532)..(538): a, c, t, g, unknown or other
  misc_feature (532)..(538): n is a, c, g, or t
  modified_base (540)..(545): a, c, t, g, unknown or other
  misc_feature (540)..(545): n is a, c, g, or t
  modified_base (547)..(547): a, c, t, g, unknown or other
  misc_feature (547)..(547): n is a, c, g, or t
  modified_base (549)..(554): a, c, t, g, unknown or other
  misc_feature (549)..(554): n is a, c, g, or t
tcagcacgctacgtcacgaccggtgctcgatttagtgagtcagtaaagggaaggggctggagtggatttcatatattagtgctggtgctactaccatgaagtacgcagactctgtgaggggccgattcaccatttccagggacgacgccaagaaatcagtatatctaacaaatgagtagcctgagagacgaggacacggctgtgtattactgtggcggggccggggagccacgtcggacccaccctacaccaagactacgtgggccacggacccgtggtccgccgtcctcctcacgcctccaccgaacggccccaatccggtccttccccctcggccctaccctccctaccgaacgacgccaccctcggtcggggacacgacgaccacgcccgtcggcgtcgccgtcggtacgtaacggacctaccgtaccgacggttacgcggttacgccgttcggacggtcgggtacgtcgggaaccgtaacgggccgtacgaagtacgngatcncgnnacgcagcnnncgcgncnnncnnnnnnncnnnnnncncnnnnnn

SEQ ID NO: 213307 - DNA, 664 bp, Homo sapiens
  misc_feature: GYAE6OF01BJH6S.30.19.B08.1.454.CMB.1.raw
  modified_base (113)..(113): a, c, t, g, unknown or other
  misc_feature (113)..(113): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (580)..(580): a, c, t, g, unknown or other
  misc_feature (580)..(580): n is a, c, g, or t
  modified_base (587)..(588): a, c, t, g, unknown or other
  misc_feature (587)..(588): n is a, c, g, or t
  modified_base (590)..(591): a, c, t, g, unknown or other
  misc_feature (590)..(591): n is a, c, g, or t
  modified_base (595)..(595): a, c, t, g, unknown or other
  misc_feature (595)..(595): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (615)..(615): a, c, t, g, unknown or other
  misc_feature (615)..(615): n is a, c, g, or t
  modified_base (622)..(622): a, c, t, g, unknown or other
  misc_feature (622)..(622): n is a, c, g, or t
  modified_base (638)..(638): a, c, t, g, unknown or other
  misc_feature (638)..(638): n is a, c, g, or t
  modified_base (649)..(649): a, c, t, g, unknown or other
  misc_feature (649)..(649): n is a, c, g, or t
tcagcacgctacgtcacgaccggtgctcgatttagtgagtcagtaagggaggggctggagtggatttcatatattagtgctggtgctactaccatgaagtacgcagactctgngagggccgattcactattccgagggacgacgccaagaaatcagtatatctaacaaatgagaagcctagagagacgaggacacggctgtgtattacngtggcggggaccgggganccgactaccgggaccaacccctacaaccaagacgtacgtggggaccgacgggaacccgtggtaccgcccgtactcctacacgccctaccaaccgaacggaccctacgtccggttacccttccccgtcggacccacccgtaccctaccgaaacgacgtacccgtacccgtccggtacgggggaccaacgaggaccctaacggtccccgtacggggccgttccggacccgggttaccggaacgtaaacgggtaacccttaaccttacccggtacggtaacggtccggtcggtaccgtgggaacggtccggggacgtacgggacggaaacgggtccgtaacgaaaggttgagactnacgagannannacanacagacgtacacananaganagtacanacgagtgcgactcganagtacgtacanacgacacgtagtacg

SEQ ID NO: 213308 - DNA, 680 bp, Homo sapiens
  misc_feature: GYAE6OF01AMLKR.30.19.B08.1.454.CMB.1.raw
  modified_base (261)..(261): a, c, t, g, unknown or other
  misc_feature (261)..(261): n is a, c, g, or t
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (631)..(632): a, c, t, g, unknown or other
  misc_feature (631)..(632): n is a, c, g, or t
  modified_base (643)..(643): a, c, t, g, unknown or other
  misc_feature (643)..(643): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (656)..(660): a, c, t, g, unknown or other
  misc_feature (656)..(660): n is a, c, g, or t
  modified_base (662)..(664): a, c, t, g, unknown or other
  misc_feature (662)..(664): n is a, c, g, or t
  modified_base (666)..(667): a, c, t, g, unknown or other
  misc_feature (666)..(667): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
  modified_base (675)..(677): a, c, t, g, unknown or other
  misc_feature (675)..(677): n is a, c, g, or t
  modified_base (679)..(680): a, c, t, g, unknown or other
  misc_feature (679)..(680): n is a, c, g, or t
tcagcacgctacgtcacgaccggtgctcgatttagtgagtcagtaagggaggggctggagtggatttcatatattagtgctggtgctactaccatgaagtacgcagacctctggtggacgggccgattccactattccgagggaccgacgccaaagaaatcgaagtatactactaacaatgaagtacgccgtagagaacggacggacggacgacggtcgttggtagttagttaaccgtggtgggaccggggccggggtacncccgtaaccgtccggaaccccaacccgtaccgaaaccgaaacgtcccgttacggtacggggaccgggtaaccgggtaaccggtcggtccgtacccggttccgtccgttaccgaccgttccaccccgaaccggtaaccgggaccccaacggttccccggttccccgtttccccgtacggaccccctacccttacccgttaccgaacgggacctcccggtacggtcggtaccggggactacgaccgacgtcggtcccgaggtccgtccgtacgtacggacgtaacgtaaccttccgacggtacgacggtctaagacgcgtacggacggtcggtacgacgtaggacgacgttagaccggntgcancctgcgcnncaagtgcctancgtaacnancngnnnnncnnngnngngtcncnnngnn

SEQ ID NO: 213309 - DNA, 543 bp, Homo sapiens
  misc_feature: GYAE6OF02G86HM.30.19.B08.1.454.CMB.1.raw
  modified_base (495)..(497): a, c, t, g, unknown or other
  misc_feature (495)..(497): n is a, c, g, or t
  modified_base (499)..(501): a, c, t, g, unknown or other
  misc_feature (499)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (514)..(522): a, c, t, g, unknown or other
  misc_feature (514)..(522): n is a, c, g, or t
  modified_base (524)..(524): a, c, t, g, unknown or other
  misc_feature (524)..(524): n is a, c, g, or t
  modified_base (526)..(528): a, c, t, g, unknown or other
  misc_feature (526)..(528): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(542): a, c, t, g, unknown or other
  misc_feature (537)..(542): n is a, c, g, or t
tcagcacgctacgtcacgaccggtgctcgattttagtgagtcagtaagggtaaagggggtcgggtaggagtggatttctatatattagtggctggtagctacgtacctatggaagtaacgcagactctgttggaggggcccgtactttcacccattttccacgggaccgacgccaagaaatcagtatagtctacgaaactgagtagcctgagagacgaggaccaccggctggtgtattacgtccggtgcgggccggggagcccaacttccggacctacccttacaccgaaagacctactggggcccaagggaaccctggtacgccgtctacctcagcctccaccaagggccccaatccggtcttacccccgtccggaccacccctcctccaacgacgacaacctctgggggcacgagccagcccgtcgggctcgcctgtcaaggctactctcgtgcactctgacgccgggctcggcaaggcgcgactacggcagnnngnnntntntgngngtgnnnnnnnnntngnnngngnncncnnnnnnc

SEQ ID NO: 213310 - DNA, 466 bp, Homo sapiens
  misc_feature: GYAE6OF02JSUZG.30.19.B08.1.454.CMB.1.raw
  modified_base (245)..(245): a, c, t, g, unknown or other
  misc_feature (245)..(245): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
  modified_base (438)..(466): a, c, t, g, unknown or other
  misc_feature (438)..(466): n is a, c, g, or t
tcagcacgctacgtcacgaccggtgctcgatttagtgagtcagtaagggaacccggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctanaccaagactactgggccagggaaccctggcgccgtctcctcagccctccaccaaggcccatcggtcttccccctggcacccctcctccaagacgcacctctgggggccacagcagcccgtggggcctcgcctggcaacggtacctacgttcctcgtacgctactctgcgngggctggcaagggtcncatagcnnnnnnnnnnnnnnnnnnnnnnnnnnnnn

SEQ ID NO: 213311 - DNA, 614 bp, Homo sapiens
  misc_feature: GYAE6OF02FO04B.30.19.B08.1.454.CMB.1.raw
  modified_base (204)..(204): a, c, t, g, unknown or other
  misc_feature (204)..(204): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (556)..(557): a, c, t, g, unknown or other
  misc_feature (556)..(557): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (583)..(583): a, c, t, g, unknown or other
  misc_feature (583)..(583): n is a, c, g, or t
  modified_base (593)..(593): a, c, t, g, unknown or other
  misc_feature (593)..(593): n is a, c, g, or t
  modified_base (607)..(607): a, c, t, g, unknown or other
  misc_feature (607)..(607): n is a, c, g, or t
  modified_base (612)..(612): a, c, t, g, unknown or other
  misc_feature (612)..(612): n is a, c, g, or t
tcagcacgctacgtcacgaccggtgctcgatttagtgagtcagtaagggtaaggggctggagtggtactttcatatatttagtgctggtgctactaccatgaagtacgcagacttctggtgaggggccgattcaccagtttccgacgggacgacgccaagaaatcgagtatatctacaatgagtagctgagagacgtaggaccncggtctgtgtattaccgtggtggccggggccgggtagccgacgtccgggaccacctacgaccaagactaccgtcgggaccgaggaaccctggcgtcctcgtcctcgacgtcccttcaccgtacggcccatcggttccttcccccgtggccctaccctacctaccacgacgcctaccctagggtcggggactacgagccgacgtaccccgttggggctacggcccgttggtaccgtaaagggtacccgttacgtttacccgacggttacgtacgtttcgacgttcggaacggtcgggtaccgtggaacgtacggccgtacgaacgtacgcgtaagcgactgagcngtccngcnnctngcncncgcacgcgtcgtacgtcnctctctcgcncgtacgcgctcgcncgcgncg

SEQ ID NO: 213312 - DNA, 256 bp, Homo sapiens
  misc_feature: GYAE6OF01CJIGL.1.53.E09.1.454.CMB.1.raw
  modified_base (254)..(256): a, c, t, g, unknown or other
  misc_feature (254)..(256): n is a, c, g, or t
tcagacgagtgcgtcacgaccggtgctcgatttagagagagtgtgttgggtttgggacagacttcactctcaccatcagcagactggagcctgaagattttgcagtgtattactgtcagcagtatggtagctcacctcaactcactttcggcggaggaccaaggtggagatcaaacgaactgtggctgcaccatctgtcttcatcttccgccatctgatatgtatactctgagcgggctggcaaggcgcatagnnn

SEQ ID NO: 213313 - DNA, 194 bp, Homo sapiens
  misc_feature: GYAE6OF01COVZL.1.53.E09.1.454.CMB.1.raw
  modified_base (167)..(167): a, c, t, g, unknown or other
  misc_feature (167)..(167): n is a, c, g, or t
  modified_base (173)..(194): a, c, t, g, unknown or other
  misc_feature (173)..(194): n is a, c, g, or t
tcagacgagtgcgtcacgaccggtgctcgatttagagagagtgtgttgggtttgggggaagaggaagactgacggtcccccaggagttcaggtgctgggcacagcggccctggggctgcctggtcaaggctacttcctctctcgactctgagcgggctggcaaggcncatagnnnnnnnnnnnnnnnnnnnnnn

SEQ ID NO: 213314 - DNA, 257 bp, Homo sapiens
  misc_feature: GYAE6OF02GH7R5.1.53.E09.1.454.CMB.1.raw
  modified_base (256)..(257): a, c, t, g, unknown or other
  misc_feature (256)..(257): n is a, c, g, or t
tcagacgagtgcgtcacgaccggtgctcgatttagagagagtgtgtcgcgggtcagggacagatttcacactgaaaatcagccgggtggaggctgaggatgttggactttattactgcatgcaagatgcacacgatccggggaacttttggccaggggaccaagctggagatcaaacgaactgtggctgcaccatctgtcttcatcttcccgccatctgaacgcactcgtctgagcgggctggcaaggcgcatagnn

SEQ ID NO: 213315 - DNA, 332 bp, Homo sapiens
  misc_feature: GYAE6OF02G7ZIM.1.53.E09.1.454.CMB.1.raw
  modified_base (271)..(272): a, c, t, g, unknown or other
  misc_feature (271)..(272): n is a, c, g, or t
  modified_base (274)..(284): a, c, t, g, unknown or other
  misc_feature (274)..(284): n is a, c, g, or t
  modified_base (286)..(286): a, c, t, g, unknown or other
  misc_feature (286)..(286): n is a, c, g, or t
  modified_base (288)..(332): a, c, t, g, unknown or other
  misc_feature (288)..(332): n is a, c, g, or t
tcagacgagtgcgtcacgaccggtgctcgatttagagagagtgtgtcggcgggtcagggacagatttcacactgaaatcagccggtgagctgagatgttggactttattactgcatgcaagatgcacacgatccggggaacttttggccctagggggaccaaggctaggtaagatcaaaacgaactgtggctgcaccatctgtcttcgatccttcccaccctcctcacggccactcgtctgacgcgggctggcaaggccgcaattagctgnntnnnnnnnnnnngngnnnnnnnnnnnnnnnnnnnnnnnnnnnnnnnnnnnnnnnnnnnnn

SEQ ID NO: 213316 - DNA, 308 bp, Homo sapiens
  misc_feature: GYAE6OF02FO1XH.1.53.E09.1.454.CMB.1.raw
  modified_base (264)..(265): a, c, t, g, unknown or other
  misc_feature (264)..(265): n is a, c, g, or t
  modified_base (267)..(267): a, c, t, g, unknown or other
  misc_feature (267)..(267): n is a, c, g, or t
  modified_base (269)..(308): a, c, t, g, unknown or other
  misc_feature (269)..(308): n is a, c, g, or t
tcagacgagtgcgtcacgaccggtgctcgatttagagagagtgtgtcggcgggtcagggacagatttcacacctgaaaatccagccgggtacggaggctgaggatgttggactttattactgcatgcaagatgcacacgatccggggaacttttggcctaggggaccaagctggagatcaaacgactgtggctgcgaccatctgtcttcatcttcccaccctcctcacgcactcgtctgagcgggctggcaaggccgcaatagnnancnnnnnnnnnnnnnnnnnnnnnnnnnnnnnnnnnnnnnnnn

SEQ ID NO: 213317 - DNA, 165 bp, Homo sapiens
  misc_feature: GYAE6OF01AF42Y.35.35.D02.1.454.CMB.1.raw
  modified_base (165)..(165): a, c, t, g, unknown or other
  misc_feature (165)..(165): n is a, c, g, or t
tcagtacagatcgtcacgaccggtgctcgatttagcacacgatagttgggtgttcggcggagggaccaggctgaccgtcctaggtcagcccaaggctgccccctcggtcactctgttcccaccctcctcacgatctgtactgagcgggctggcaaggcgcatagn

SEQ ID NO: 213318 - DNA, 173 bp, Homo sapiens
  misc_feature: GYAE6OF01DQF1L.35.35.D02.1.454.CMB.1.raw
  modified_base (171)..(173): a, c, t, g, unknown or other
  misc_feature (171)..(173): n is a, c, g, or t
tcagtacagatcgtcacgaccggtgctcgatttagcacacgatagttgggtttgggtgttcggcggagggaccaggctgaccgtcctaggtcagcccaaggctgccccctcggtcactctgttcccaccctcctcacgatctgtactgagcgggctggcaaggcgcatagnnn

SEQ ID NO: 213319 - DNA, 201 bp, Homo sapiens
  misc_feature: GYAE6OF01CS119.35.35.D02.1.454.CMB.1.raw
  modified_base (169)..(169): a, c, t, g, unknown or other
  misc_feature (169)..(169): n is a, c, g, or t
  modified_base (175)..(201): a, c, t, g, unknown or other
  misc_feature (175)..(201): n is a, c, g, or t
tcagtacagatcgtcacgaccggtgctcgatttagcacacgatagttgggtttgggtggttcggcggagggaccaggctgaccgtccgtaggtcagcccaaggctgccccctcggtcactctgttcccacccttcctcacgatctgtactgagcgggctggcaagggcncatagnnnnnnnnnnnnnnnnnnnnnnnnnnn

SEQ ID NO: 213320 - DNA, 166 bp, Homo sapiens
  misc_feature: GYAE6OF01BYW71.35.35.D02.1.454.CMB.1.raw
  modified_base (165)..(166): a, c, t, g, unknown or other
  misc_feature (165)..(166): n is a, c, g, or t
tcagtacagatcgtcacgaccggtgctcgatttagcacacgatagttgggtgttcggcggagggaccaggctgaccgtcctaggtcagcccaaggctgccccctcggtcactctgttcccaccctcctcacgatctgtactgagcgggctggcaaggcgcatagnn

SEQ ID NO: 213321 - DNA, 166 bp, Homo sapiens
  misc_feature: GYAE6OF01DEXED.35.35.D02.1.454.CMB.1.raw
  modified_base (163)..(166): a, c, t, g, unknown or other
  misc_feature (163)..(166): n is a, c, g, or t
tcagtacagatcgtcacgaccggtgctcgatttagcacacgatagttgggtgttcggcggagggaccaggctgaccgtcctaggtcagcccaaggctgccccctcggtcactctgttcccaccctcctcaatctgtactgagcgggctggcgaagcgcatagnnnn

SEQ ID NO: 213322 - DNA, 175 bp, Homo sapiens
  misc_feature: GYAE6OF01CNC65.35.35.D02.1.454.CMB.1.raw
  modified_base (173)..(175): a, c, t, g, unknown or other
  misc_feature (173)..(175): n is a, c, g, or t
tcagtacagatcgtcacgaccggtgctcgatttagcacacgatagttgggtttgggtgttcggcggagggaccaggctgaccgtcctaggtcagcccaaggctgccccctcggtcactctgttcccgccctcctcacgatctgtactgagcgggcgtggcgaaggcgcatagnnn

SEQ ID NO: 213323 - DNA, 172 bp, Homo sapiens
  misc_feature: GYAE6OF01DBE8C.35.35.D02.1.454.CMB.1.raw
  modified_base (171)..(172): a, c, t, g, unknown or other
  misc_feature (171)..(172): n is a, c, g, or t
tcagtacagatcgtcacgaccggtgctcgatttagcacacgatagttgggtttgggtgttcggcggagggaccaggctgaccgtcctaggtcagcccaaggctgccccctcggtcactctgttcccaccctcctcacgatctgtactgagcgggctggcaaggcgcatagnn

SEQ ID NO: 213324 - DNA, 172 bp, Homo sapiens; identical to SEQ ID NO: 213323
  misc_feature: GYAE6OF01ENZ8V.35.35.D02.1.454.CMB.1.raw
  modified_base (171)..(172): a, c, t, g, unknown or other
  misc_feature (171)..(172): n is a, c, g, or t

SEQ ID NO: 213325 - DNA, 171 bp, Homo sapiens
  misc_feature: GYAE6OF01C7R5N.35.35.D02.1.454.CMB.1.raw
  modified_base (171)..(171): a, c, t, g, unknown or other
  misc_feature (171)..(171): n is a, c, g, or t
tcagtacagatcgtcacgaccggtgctcgatttagcacacgatagttgggtttgggtgttcggcggagggaccaggctgaccgtcctaggtcagcccaaggctgccccctcggtcactctgttcccgccctcctcacgatctgtactgagcgggctggcaaggcgcatagn

SEQ ID NO: 213326 - DNA, 168 bp, Homo sapiens
  misc_feature: GYAE6OF01C1OVW.35.35.D02.1.454.CMB.1.raw
  modified_base (166)..(168): a, c, t, g, unknown or other
  misc_feature (166)..(168): n is a, c, g, or t
tcagtacagatcgtcacgaccggtgctcgatttagcacacgatagttgggtgttcggcggagggaccaggctgaccgtcctaggtcagcccaaggctgccccctggtcactctcgttcccaccctcctcacgatctgtactgaggcgggctggcaaggcgcatagnnn

SEQ ID NO: 213327 - DNA, 170 bp, Homo sapiens
  misc_feature: GYAE6OF01CUROU.35.35.D02.1.454.CMB.1.raw
  modified_base (170)..(170): a, c, t, g, unknown or other
  misc_feature (170)..(170): n is a, c, g, or t
tcagtacagatcgtcacgaccggtgctcgatttagcacacgatagttgggtttgggtgttcggcggagggaccaggctgaccgtcctaggtcagcccaaggctgccccctggtcactctgttcccgccctcctcacgatctgtactgagcgggctggcaaggcgcatagn

SEQ ID NO: 213328 - DNA, 175 bp, Homo sapiens
  misc_feature: GYAE6OF01EX5YY.35.35.D02.1.454.CMB.1.raw
  modified_base (171)..(175): a, c, t, g, unknown or other
  misc_feature (171)..(175): n is a, c, g, or t
tcagtacagatcgtcacgaccggtgctcgatttagcacacgatagttgggtttgggtgttcggcggagggaccaggctgaccgtcctaggtcagcccaaggctgccccctggtcactctgttccccaccctcctcacgatctgtactgagcgggctggcaaggcgcatagnnnnn

SEQ ID NO: 213329 - DNA, 178 bp, Homo sapiens
  misc_feature: GYAE6OF02H5162.35.35.D02.1.454.CMB.1.raw
  modified_base (165)..(178): a, c, t, g, unknown or other
  misc_feature (165)..(178): n is a, c, g, or t
tcagtacagatcgtcacgaccggtgctcgatttagcacacgatagttgggtggttcggcggagggaccaggctgaccgtcctaggtcagcccaaggctgcccctcggtcactctgttcccaccctcctcacgatctgtactgagcgggctggcaaggcgcatagnnnnnnnnnnnnnn

SEQ ID NO: 213330 - DNA, 171 bp, Homo sapiens
  misc_feature: GYAE6OF02IIZH8.35.35.D02.1.454.CMB.1.raw
  modified_base (170)..(171): a, c, t, g, unknown or other
  misc_feature (170)..(171): n is a, c, g, or t
tcagtacagatcgtcacgaccggtgctcgatttagcacacgatagttgggtttgggtgttcggcggagggaccaggctgaccgtcctaggtcagcccaaggctgcccctcggtcactctgttcccgccctcctcacgatctgtactgagcgggctggcaaggcgcatagnn

SEQ ID NO: 213331 - DNA, 173 bp, Homo sapiens
  misc_feature: GYAE6OF02GOUYQ.35.35.D02.1.454.CMB.1.raw
  modified_base (170)..(173): a, c, t, g, unknown or other
  misc_feature (170)..(173): n is a, c, g, or t
tcagtacagatcgtcacgaccggtgctcgatttagcacacgatagttgggtttgggtgttcggcggagggaccaggctgaccgtcctaggtcagcccaaggctgcccctcggtcactctgttcccaccctcctcacgatctgtactgagcgggctggcaaggcgcatagnnnn

SEQ ID NO: 213332 - DNA, 172 bp, Homo sapiens
  misc_feature: GYAE6OF02HA37P.35.35.D02.1.454.CMB.1.raw
  modified_base (171)..(172): a, c, t, g, unknown or other
  misc_feature (171)..(172): n is a, c, g, or t
tcagtacagatcgtcacgaccggtgctcgatttagcacacgatagttgggtttgggtgttcggcggagggaccaagctgaccgtcctaggtcagcccaagactgccccctcggtcactctgttcccgccctcctcacgatctgtactgagcgggctggcaaggcgcatagnn

SEQ ID NO: 213333 - DNA, 172 bp, Homo sapiens
  misc_feature: GYAE6OF02G4UKY.35.35.D02.1.454.CMB.1.raw
  modified_base (171)..(172): a, c, t, g, unknown or other
  misc_feature (171)..(172): n is a, c, g, or t
tcagtacagatcgtcacgaccggtgctcgatttagcacacgatagttgggtttgggtgttcggcggagggaccaggctgaccgtcctaggtcagcccaaggctgccccctcggtcactctgttcccgccctcctcacgatctgtactgagcgggctggcaaggcgcatagnn

SEQ ID NO: 213334 - DNA, 172 bp, Homo sapiens; identical to SEQ ID NO: 213333
  misc_feature: GYAE6OF02HXMN3.35.35.D02.1.454.CMB.1.raw
  modified_base (171)..(172): a, c, t, g, unknown or other
  misc_feature (171)..(172): n is a, c, g, or t

SEQ ID NO: 213335 - DNA, 172 bp, Homo sapiens; identical to SEQ ID NO: 213323
  misc_feature: GYAE6OF02FLZW3.35.35.D02.1.454.CMB.1.raw
  modified_base (171)..(172): a, c, t, g, unknown or other
  misc_feature (171)..(172): n is a, c, g, or t

SEQ ID NO: 213336 - DNA, 188 bp, Homo sapiens
  misc_feature: GYAE6OF02GIEIM.35.35.D02.1.454.CMB.1.raw
  modified_base (167)..(167): a, c, t, g, unknown or other
  misc_feature (167)..(167): n is a, c, g, or t
  modified_base (173)..(188): a, c, t, g, unknown or other
  misc_feature (173)..(188): n is a, c, g, or t
tcagtacagatcgtcacgaccggtgctcgatttagcacacgataggttgggtttgggtgttcggcggagggaccaggctgaccgtcctaggtcagcccaaggctgccccctggtcactctgttcccaccctcctcacgatcttgtactgagcgggctggcaaggcgntatagnnnnnnnnnnnnnnnn

SEQ ID NO: 213337 - DNA, 194 bp, Homo sapiens
  misc_feature: GYAE6OF02IXWZL.35.35.D02.1.454.CMB.1.raw
  modified_base (171)..(194): a, c, t, g, unknown or other
  misc_feature (171)..(194): n is a, c, g, or t
tcagtacagatcgtcacgaccggtgctcgatttagcacacgatagttgggttgggtgttcggcggagggaccaggctgaccgtcctaggttcagcccaaggctgccccctggtcactctgttcccgccctctcacgatctgtactgagcgggctgggcaaggtcgcatagnnnnnnnnnnnnnnnnnnnnnnnn

SEQ ID NO: 213338 - DNA, 735 bp, Homo sapiens
  misc_feature: GYAE6OF01EQHCG.36.56.F01.1.454.CMB.1.raw
tcagtacgctgtctcacgaccggtgctcgatttagcagacgtctgtcgtgggagagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgaggtgaaggtctcctgcaagtacttctggatacgaccttcactagtttatagtaaatactaacgtggggtacgcgaaccgagggccaacgacggacgaagggtcttggaggtggaagtgggagtggggtagtaacccgttaagtaggtggtagacaacgaggtaactttaggacgacgacgaagtaacggtttccggacgggacgaagtaacaccgtaaccgacgttaacgaacccgaagaaaacccgtacggtaacccttaccgaaacttaaaccgtaaccgttaacgttttaacctaacgtacgggttaaacgtacggaaacgttacgttaccgtacggtaacggtaccgtaccgggtaacggaaccgtaaacccgggtaccgttaaacgttttaaccggtttacgttaccgggttaacggtaccggtaaacgggtaacgtaaaccggttaaacgggtttaacggtttttaccgggtaacggttaagggtttaaggtaaaacccggg

SEQ ID NO: 213339 - DNA, 664 bp, Homo sapiens
  misc_feature: GYAE6OF02GWSCG.36.56.F01.1.454.CMB.1.raw
  modified_base (402)..(402): a, c, t, g, unknown or other
  misc_feature (402)..(402): n is a, c, g, or t
tcagtacgctgtctcacgaccggtgctcgatttagcagacgtctgtcgtgggagagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagccgtggggcctcgagtagaaggtcctccgtgacaagtcttactggacttacgaccttcactagtttatagaaactcaacgtgggtcgtacgacgacggcccacgaacggacgaagggtcgttacggaggttcgggagtagggagttggggtacgtaaccgttagtaggtggtacgacaacgagtattagngacgaacgtagtaacgttccgagggtacgaagtaactacaaccgtagtacgaacgaaacgaaacgacgaccgttaccaaactaaaccgaactaacgtttaaccaagttaacggtaaactacggtaaactacgtacgtacgacgtaccgtaccggaacggaccggaacccgtacggttaacttaacgttcggtacggtcgtaacggaacgaacggtaacgtacggtttaaggttttacggtacgttacggtacgttaaacggg

SEQ ID NO: 213340 - DNA, 753 bp, Homo sapiens
  misc_feature: GYAE6OF02FN3O7.36.56.F01.1.454.CMB.1.raw
tcagtacgctgtctcacgaccggtgctcgatttagcagacgtctgtcgtgggagagcatcacccagcaaccacatctgtcctctagagaatcccctgagagctccgttcctcaccactggacgtggaccgtcggaggatcctcttcttggtggcgagcagccacaggagcccacctcccacggtgcagcgtggtgcagtcgtggggcgtgaggtggaagaaggaccgtcggggcgtcagtgaggtctcctgcaagacttctcggataaccaccctttcgacccggtactacttaactattcgcctaacgtggggtagccgaacgtagggccccgtggaacggaaagggtccgttggaacggtagggtacgtaggggattagggtaacgtacccgtaaaccccgtaaacggtaggttcggggttacggaaccctaaaccgtaaaaacgtttcgtacgaaccgtaaacggaacggtttaaaacggtttccgggtacggggtacggtaacggggttaccgtaacccgtaacgtacgggtaacccgaaacggggggtaaccctaacccggtacccgtaacgttaaccgacgtaccgtaacgtaaccgtacctaacgtaggtacggacggtcgtacgaacgcggtacggtacgtagtacggtacgtacgacgtaacgaccggtaaccggtccgttacggttaacgttacgtacggtcggtacggaagggtacgggtacgggttaagttaggttaacgg

SEQ ID NO: 213341 - DNA, 245 bp, Homo sapiens
  misc_feature: GYAE6OF01C8IYM.48.27.C05.1.454.CMB.1.raw
  modified_base (244)..(245): a, c, t, g, unknown or other
  misc_feature (244)..(245): n is a, c, g, or t
tcagagtatacatacacgaccggtgctcgatttagacgcgatcgaagggtttggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagnn

SEQ ID NO: 213342 - DNA, 446 bp, Homo sapiens
  misc_feature: GYAE6OF01CDUN8.48.27.C05.1.454.CMB.1.raw
  modified_base (406)..(406): a, c, t, g, unknown or other
  misc_feature (406)..(406): n is a, c, g, or t
  modified_base (414)..(446): a, c, t, g, unknown or other
  misc_feature (414)..(446): n is a, c, g, or t
tcagagtatacatacacgaccggtgctcgatttagacgcgatcgaagggctggtgtggggtctcacgtattaatagtgatgggactgacacaatctacgcggactccgtgaagggccgacttccaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggccccatcggtcttccccctggcgccctgctccaggagcacctcgagagcacagcggccctgggctgcctggtcaaggactacttcctatgtatactctgagcgggctgggcaagggcncgataggnnnnnnnnnnnnnnnnnnnnnnnnnnnnnnnnn

SEQ ID NO: 213343 - DNA, 245 bp, Homo sapiens
  misc_feature: GYAE6OF01AV78N.48.27.C05.1.454.CMB.1.raw
  modified_base (245)..(245): a, c, t, g, unknown or other
  misc_feature (245)..(245): n is a, c, g, or t
tcagagtatacatacacgaccggtgctcgatttagacgcgatcgaagggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatagn

SEQ ID NO: 213344 - DNA, 665 bp, Homo sapiens
  misc_feature: GYAE6OF01BMFSX.48.27.C05.1.454.CMB.1.raw
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagagtatacatacacgaccggtgctcgatttagacgcgatcgaagggtttgggggtggtccagaggcagaactctgggtcgtctcaccataggacctggataccctctaccttctcccccgttcctcctacttctctggcacaggctcctgaggccgtccctatcgaacgtgacacagccacccgtcggtggtccaggtcgtccccgaggacacgtaccgggacccaggactctacgtgctctgcagagacgttcgccaagtccaattttcggtttttggtactcggagtcgtacggaacgtacccgaaggggaccgtacggtcccccgaaaggtaccgtagtccgtacaatgttactaggtacggacgngtagtagacggtccctccagggaactcccgtgacgcgacttcgcnggcctacgagctcgngggacctnacgttcacttctgactactccagtgaacgtccgggctacgaagttacggaggactagactaactacttacgtcgagtcagggtacggactaagtaccgtacgtacaccgtacgtaacgtacctcggttccggacgggtaccgggaccgtaacgccgtacggaacccacggttcccgtacggtcccgtacgccccgaaggtcccgtaccggtccccccgtaccggg

SEQ ID NO: 213345 - DNA, 252 bp, Homo sapiens
  misc_feature: GYAE6OF01BUNL7.48.27.C05.1.454.CMB.1.raw
  modified_base (249)..(252): a, c, t, g, unknown or other
  misc_feature (249)..(252): n is a, c, g, or t
tcagagtatacatacacgaccggtgctcgatttagacgcgatcgaagggtttggggggtgtggtggtctccactcccgccttgacgaggctgattactactgtcagtcttttgataacaacaatcacgtggtcttcggcggagggaccagcctgaccgtcctaggtcagcccaaggctcgccccctcggtcactctcgttccccaccctcctctatgtatactctgagcggctggcaaggcgcagtagnnnn

SEQ ID NO: 213346 - DNA, 651 bp, Homo sapiens
  misc_feature: GYAE6OF01DHNTE.48.27.C05.1.454.CMB.1.raw
  modified_base (198)..(198): a, c, t, g, unknown or other
  misc_feature (198)..(198): n is a, c, g, or t
  modified_base (340)..(340): a, c, t, g, unknown or other
  misc_feature (340)..(340): n is a, c, g, or t
  modified_base (453)..(453): a, c, t, g, unknown or other
  misc_feature (453)..(453): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
tcagagtatacatacacgaccggtgctcgatttagacgcgatcgaagggctggtgtgggtctcacgtattaatagtgatgggactgacacaatctacgcggactccgtggaaggccgattccaccccctccagagacaacgccaagaacacactatatctgacaaatgaacagtctgagagccgagacacggtctgtntattctgtgacaagaggtgctaacaatctagtttggtttgacttcgtcggtcggggaccaaagggtataaggtcggtacctacgtccttcgtcaccgccctaaccgaccggaacggtccctagttcccgttccctccccggnggcccgtaccccttgccgtaccgacggcgacctacccgtccgaagtaggcctacgccggccggtcccgtggcctccggtccgtaggtaccgtaacgtacccttacctttacgngttaaccgtagttcccgtgtacgggaccggttacgggcgtacggtacgtaccgggtacctagtaggaaccgtncgtaacgngtcgtcgtcgtcgacgtacgtacgtcgtacgtcgtacgtacgtgacgtacgtacgtgtcgtaccgtcgtacgtcgtacgcgtcgtacgcgtaacgtacgtacgtcgtacgcgtcgcg

SEQ ID NO: 213347 - DNA, 248 bp, Homo sapiens
  misc_feature: GYAE6OF02F1HNO.48.27.C05.1.454.CMB.1.raw
  modified_base (244)..(248): a, c, t, g, unknown or other
  misc_feature (244)..(248): n is a, c, g, or t
tcagagtatacatacacgaccggtgctcgatttagacgcgatcgaagggtttgggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccaccctcctctatgtatactctgagcgggctggcaaggcgcatagnnnnn

SEQ ID NO: 213348 - DNA, 236 bp, Homo sapiens
  misc_feature: GYAE6OF01CLKOA.36.5.A05.1.454.CMB.1.raw
  modified_base (235)..(236): a, c, t, g, unknown or other
  misc_feature (235)..(236): n is a, c, g, or t
tcagtacgctgtctcacgaccggtgctcgatttagatagatagacagggagagtgttagagggagaagtgccccacctgctcctcagttccagcctgacccctcccatcctttggcctctgaccctttggccaggggaccaagctggagatccaacgaactgtggctgcaccatctgtcttcatcttcccgccatctgaagacagcgtactgagcgggctggcaaggcgcatagnn

SEQ ID NO: 213349 - DNA, 516 bp, Homo sapiens
  misc_feature: GYAE6OF01ENK29.36.5.A05.1.454.CMB.1.raw
  modified_base (503)..(503): a, c, t, g, unknown or other
  misc_feature (503)..(503): n is a, c, g, or t
  modified_base (509)..(516): a, c, t, g, unknown or other
  misc_feature (509)..(516): n is a, c, g, or t
tcagtacgctgtctcacgaccggtgctcgatttagatagatagacagggtgtacacctgtggttctcggggctgcctttttggttttggagatggttttctcgatgggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgcgaccctaggatattgcaatggggttactgctccgcgggggcgctggtagatgcttttgacatctggggccaagggacgatggtcaccgtctcttcagcctcaccaagggcccatcggtcttccccctggccgccctgcctccaggacgcacccgtccgagacgcacagccggccctgggctgcctggtcaaggcctacttccagacagcgtactggagcgggctgggcaagggcncatagnnnnnnnn

SEQ ID NO: 213350 - DNA, 546 bp, Homo sapiens
  misc_feature: GYAE6OF01D8TD9.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgaattggtttacaaaagaggccaggccaatctccaaggcgacctaatttatcaggtttctaaccgggactcgtcggggtcccggacagattcagcggcaggtgggtcaggcactgatttcacactagaaatcagcgagggtggaggctggagggtagttggtttaggggtttattacgtgcagtgacaaggtacatacgtcggtccttccgtactacgtttcggccgtagggaccaagcgtagggacgtactaccgaacgaacgtggtacggtctagaccacctagtctcg

SEQ ID NO: 213351 - DNA, 555 bp, Homo sapiens
  misc_feature: GYAE6OF01DT74Z.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtccccagtatcaagcagggatgttgtgatgactcagtctccagtctccctgcccgtcacccttggacagccggcctccatctcctgcaggtctagtcacagcctccttttcagtgatggaaacacctacttgtaattggtttcaacagaggccaggccaatctccaaggcgcctaatttatctaggtttctaaccgggactcgtcggggtcccgacagattcagcggcaggtggtcaggcactgtactttcactactagaaatcagcgtaggggtggaggctggaggtagttggtttggggtttaatttacgtgctatggacgtaaggtacatacgtggcccttcggtactacgtttcggaccgtaggggacccaagtcgtaggagtactacccgaacgtaacgtggtacggcctagcctacgagttccg

SEQ ID NO: 213352 - DNA, 580 bp, Homo sapiens
  misc_feature: GYAE6OF01CD3UU.36.5.A05.1.454.CMB.1.raw
tcagtacgctgtctcacgaccggtgctcgatttagatagatagacaggggtgatcaggactcctcagttcaccttctcacaatgaggctccctgctcagctcctgggctgctaatgctctgggtcccagtatcaagcagggatgttgtgatgactcagtctccagtctccctgcccgtcacccttggacagccggcctccatctcctgcaggtctagtcacagccttccttttcagtgataggaaacacctacttgaatttggttacaacagaggccaggccaatcctaccaaggcgaccttaatttatcgtaggttttactaaaccgggcttcgtcggggtacccgacagtattcagcggcaggtgggtcaggcacgtgtatttcacactagaaatcagcgagggtggaggcgtaggaggtagttagggtttaggggtttaattacgtgacgtagtagtacgtaaggtacagttaccgtgggtccttaccgtactacgttttcggaccgtacggggaccaaggtacgtagggacgtactaccgaaacgacgttggacggtctacgaccacctgtcttcg

SEQ ID NO: 213353 - DNA, 549 bp, Homo sapiens
  misc_feature: GYAE6OF01E0W61.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgaatttggtttcaacagaggccaggccaatctccaaggcgcctaatttatcaggttttctaaccgggactcgtggggtcccgacagattcagcggcagtgggtcaggcactgatttcacactgaaatcagcgagggtggaggctgaggatgtttgggttattacgtgctatgcgaaggtacaatacgtcggtccttccgttaactacgttttcggccgtaagggggacccaaaggccttaggacgtagtacccaaacggtaacgtggacggtcgttacgacaccctatcgttacg

SEQ ID NO: 213354 - DNA, 515 bp, Homo sapiens
  misc_feature: GYAE6OF01BFFMT.36.5.A05.1.454.CMB.1.raw
  modified_base (400)..(400): a, c, t, g, unknown or other
  misc_feature (400)..(400): n is a, c, g, or t
  modified_base (509)..(515): a, c, t, g, unknown or other
  misc_feature (509)..(515): n is a, c, g, or t
tcagtacgctgtctcacgaccggtgctcgatttagatagatagacagggtgtacacctgtggttctcggggctgccctttggttttggagatggttttctcgatgggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgcgaccctaggatattgcaatgggggttactgctccgcgggggcgctggtagatgcttttgacatctggggccaagggacgatggtcaccgtctcttcagcctccaccaagggcccatcggtcttccccctggcnccctgcctccaggagcacctccgagagccacacgccggccctgggctgcctggtcaagggacctacttccgagacagcgtacgtgagcgggctggcaaggcgcatagcnnnnnnn

SEQ ID NO: 213355 - DNA, 871 bp, Homo sapiens
  misc_feature: GYAE6OF01BN3KQ.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacacgccggcctccatctcctgcaggtctagtcacagcctccttttcagtgatggaaacacctacttgaattggttcaacagaggccaggccaatcctaccgaaacgggccgtacccttaaattttactaccgtaacgggttttaccgtaaacccggggtaccttccggtacgggggtaccccggaactaacggtacgtttccgaacggtccgggacgtaagggttcggggttaccacggggtacctaacgttaggtaacttttaccgaaacctaaccgttaagtaaaaacgttaccgtaacggtaccggtaacggggggttaggggtaacgggtaccggttagggtaaaggggtaggtttaggggtttttacggggggttttttaaacgtttaccggtttacggtccgttaacggttacgggtaaccgttaaaacggggttaaccttaacggtttaaccggttaccggggtacccccgtttacccgggtttaacccgtttaacccgggttttttaccggggaacccccggtaacggggggtaaaccccgtaaacgggtacccggttaacggggtaacgggttaaccgtaaccccggtaaaacccgggttaaaccggtttacggggttacgggtacccgttacgggaacccgtaaccccgttaaccgtttcccgtttacccgg

SEQ ID NO: 213356 - DNA, 611 bp, Homo sapiens
  misc_feature: GYAE6OF01C6J0O.36.5.A05.1.454.CMB.1.raw
  modified_base (317)..(317): a, c, t, g, unknown or other
  misc_feature (317)..(317): n is a, c, g, or t
  modified_base (349)..(349): a, c, t, g, unknown or other
  misc_feature (349)..(349): n is a, c, g, or t
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacacgcctccttttcagtgattggaaaccaccttacttgtaaatttggtttacaactagaggccagggccaaatcgtccaaaggcgcctaatttancaggttttcaaccgggctcgtggggtcccgangacttcgagcggcagtgggtcagggcacgtgatttcactactagtaaactcaagtcgaggggtggaggcgtaggaggtagttggtttgggggtttaatacgttgtcagtggacgtaaaggtactaagttaacgttcggcccttaccggttaacgttaccgtttttcgggacccgtacgggggaacccaaggtccgtagggacgtacgtacccgtaaacgtaacgttcggtacgggtaccgtacgaccgacccgtattacccg

SEQ ID NO: 213357 - DNA, 729 bp, Homo sapiens
  misc_feature: GYAE6OF01BXQRL.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctcagtctccctcgcccgtcacccttggacacgccggcctccatctcctgcaggtctagtcacacgtccttcctttcagtgataggaaactacctacttgtaatttggttacaacgaggacggaccacggccaatcctaccgaacggccgtacctttaatttactacgttaacgggtttaccgtaaacccgggtacgttccggtacgggggtaccccggtagaacgtacgttaccgacgggccgggtacgtacgggtcgggtacacggactacgtagtactttacaaccgtacgtaagtaaaatcgaaggtcgaaggggtaggacggtcgtagggtagggtagtttagggttttaggggttttaacttacgttacgacgtaagtacggtaacgtaacggtaactaacgttaaccggttcgggtacccgtttaccgttaccgttaccggtttacgggacccggtaacggggtaaccgtaacggtcgtaacgggtaacgtaaccgtaccggtaaacggtacgttcgggtacggtcccgtacgtacccgtaacccgttacgttcgttacccg

SEQ ID NO: 213358 - DNA, 637 bp, Homo sapiens
  misc_feature: GYAE6OF01A6DQ0.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgaattggtttcaacagaggccaggccaatctccaagcgcctaatttatctaggtttctaaccgggactcgtcgggtcccggacagattcgagcggcaggtgggtcaggcactgatttcactactagaaatcgagcgaggggtaggaggtcgtaggaaggtagttgggttttagggggtttatttaaccgttggaccgtagtcggtacgtaaacggggttactaacgttaaccgttcggggtacccctttacccgggtaaccgttaccgtttttccggggacccgtaacggggggtacccaaacgggtccgtacggggtaagtaacgttcccgaaaacggtacttacgggtacggtaccgtagacccgaacccgtagttcccg

SEQ ID NO: 213359 - DNA, 564 bp, Homo sapiens
  misc_feature: GYAE6OF01DOCS0.36.5.A05.1.454.CMB.1.raw
  modified_base (556)..(556): a, c, t, g, unknown or other
  misc_feature (556)..(556): n is a, c, g, or t
  modified_base (558)..(562): a, c, t, g, unknown or other
  misc_feature (558)..(562): n is a, c, g, or t
  modified_base (564)..(564): a, c, t, g, unknown or other
  misc_feature (564)..(564): n is a, c, g, or t
tcagtacgctgtctcacgaccggtgctcgatttagatagatagacagggtgtacacctgtggttctcggggctgccctttggttttggagatggttttctcgatgggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgcgaccctaggatattgcaagtggggttactgctccggcgggggcgcgtggtagatgtcttttgacatcgtggggccaagggacgagtggtcaccgtctcttcagcctccaccgaacgggcccagtccggtccttcccccgtggccgccctgcctccgaggacgccacctccgagacgcacgacggccggcccgtgggcctggcccgtggtaccgaacggaccttaccgttcccgacgaccagtccgtactcggacgcggggctcgggaccgtaagggccgacgagtagcngnnnnngn

SEQ ID NO: 213360 - DNA, 572 bp, Homo sapiens
  misc_feature: GYAE6OF01D1GWO.36.5.A05.1.454.CMB.1.raw
  modified_base (296)..(296): a, c, t, g, unknown or other
  misc_feature (296)..(296): n is a, c, g, or t
tcagtacgctgtctcacgaccggtgctcgatttagatagatagacaggggtcagagaggagccttagccctggactccaaggcctttccacttggtgatcagcactgagcacagaggactcaccatggaactggggctccgctgggttttccttgttgctattttagaaggtgtccagtgtgaggtgcagctggtggagtcgtggggggagcctggtcaagccgtggggggtccctgagactctcctgtgcagcctctggattcaccttcagtagctatagcatgaactgggtccnccgaggctccgaggggaagggctgggagtgggtctcatccattagtagtagtagtagttacatatactacgcagactcagtggaacgggccattcaaccatcctaccagtacgaacaaccgaccaaagaacctcaactgtactcgtagacaaatgaaaccagtacctagacgacgcccggaaggaccacgggtctgtagtatttacggtggtagggcggggtatcgggacgttaatttagttttacgaactttgggtttaacctttccgttaaacc

SEQ ID NO: 213361 - DNA, 806 bp, Homo sapiens
  misc_feature: GYAE6OF01EQ1BN.36.5.A05.1.454.CMB.1.raw
tcagtacgctgtctcacgaccggtgctcgatttagatagatagacaggggtgatcaggactcctcagttcaccttctcacaatgaggctccctgctcagctcctgggctgctaatgctctgggtcccagtatcaagcagggatgttgtgatgatcagtctccagtcctccctcgcccgtccacccgttggacacgccggcctccatctcctgcaggtctagtcacacgtccttccttttcagtgatacggaaacctaccttagttagtaagtttcggttacaacagacggaccaggtaccaatccgtaccgaaacggccgtacctttaaagtttacgttaccgtaacgggttttaccgtaaacccgggtacgttccggttacgggggtaccccggtaacgaacgtacgttacgtaaacgggccggtaccggtaagggttcggggtaccgaacgggtccgaaaccgttcgggttaaactttttcccaaaacggttaacccttaaacggtaaaaacgttaccgaaacggtaccgggtaagggggtttaacggggacgggtaacggttaggggtaagggttaacggttttaggggttttacggggttttaacgtttaacgttcggttacgtaacggttacggaacggttaaacggtaaccttaagttacccgtaccggttacccgttaccgttaccgttacgtttacgggaacccggtacgggtaaccgtaaacgtcggtagggaacgtaacgtacccggtaaacgtacgtcggtaacggtcctacggacctaaccgtgtcgtttaccg

SEQ ID NO: 213362 - DNA, 565 bp, Homo sapiens
  misc_feature: GYAE6OF01CBBLI.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgaattggttcaacagaggccaaggccaatctccaaggcgcctaatttatcaggtttctaaccgggactctggggtcccggacagattcagcggcagtgggtcaggcactgatttcacactagaaatcagcgagggtggaggctgaggtagtggtttaggggtttattacgtgtctagtgacaaggttaacattacgtgggtccctaccggttacctaccgttttacggccgtaacggggaccaaaggccgttagggacgatacccgaaacggtaactggtaggtccgtacgacctaccgtacgttcttcgg

SEQ ID NO: 213363 - DNA, 720 bp, Homo sapiens
  misc_feature: GYAE6OF01AXHG6.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctcgcccgtccacccttggacacgccggcctccatctcctgcaggtctagtcacacgtccttccttttcagtgataggaaacctaccttacttagtaatttcggtttacaaacgaggtacggaccaaggacccaactccgtacccgaagggtcccgtaccttaaatttactccgtaacgggttttaccgtaaacccgggtacgttccggttacgggggtcccggaacgtaggtacttccgaacgggccggacgtagggtcgggtacgacggtactacgtaggttactttacgaaacctacgtaagtaaactcgaacggtcgtaagggggtggacgggtcgtagggaacgggttagttggggttttaggggttttaacttacgtaggtacgtagtacgaacgtaaggtactaacgttacgtcggtacccttacgttaacgttaccggtttacggacccgtacggggtaacctacggtacggtacgggaacgtaaccggacccgtaaacgtaccgtggtacgtacgtcgaacgtaccctagttccgttacg

SEQ ID NO: 213364 - DNA, 855 bp, Homo sapiens
  misc_feature: GYAE6OF01EMT53.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtcctccctgcccgtcacccttggacagcccggcctccatctcctgcaggtctagtcacacgtccttccttttcagtgataggaaaacctaccttacttgtaatttcgggtttacaaacgaggtaacggcccaacgggaccctaaatccgtacccgaaacgggtcccggtaccctttaaacgttttaacttccgtaacgggtttttacccgtaaaacccggggtaccttaccggttaccggggggtaccccggaacgtaagtacgttacgaacgggtccgggacgtaggggttcggggtccaacggggtctaaccgttaggtacttttaccaaccgtaacgttaaggaaaacttaccggaacggtacgggtaagggggttacggggaagggtccggttaagggtaacggggttaaggttttaggggtttttagggggggtttttaactttaaccggttacgggtaccgttaagttcgggtaaccggtaaagggttaaccgtaacgtttaacccggtcgggttaccccgtttacccgtttaaccgttaaccggtttttaccgggacccggtaacgggggaacccgtaacggtacggtacgggtaaccgtaaccgttaacccggaaaccggtaaaccggttgggtacgggtacccgttacggacccgtaaccgttaacgttccgtttaccgg

SEQ ID NO: 213365 - DNA, 516 bp, Homo sapiens
  misc_feature: GYAE6OF01B2C6U.36.5.A05.1.454.CMB.1.raw
  modified_base (436)..(436): a, c, t, g, unknown or other
  misc_feature (436)..(436): n is a, c, g, or t
  modified_base (504)..(504): a, c, t, g, unknown or other
  misc_feature (504)..(504): n is a, c, g, or t
  modified_base (510)..(516): a, c, t, g, unknown or other
  misc_feature (510)..(516): n is a, c, g, or t
tcagtacgctgtctcacgaccggtgctcgatttagatagatagacagggtgtacacctgtggttctcggggctgccctttggttttggagatggttttctcgatgggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgcgaccctaggatattgcaatgggggttactgctccgcgggggcgctggtagatgcttttgactatcgtggggccaagggacgatggtcaccgtctcttcagcctccaccgaagggcccatccggtccttcccccgtggccgccctcgcctccaggacgccacctccgagngcacagcgccctggctgcctggtcaaggctacttccagacagcgtactggagcgggctggcaagggcncatagnnnnnnn

SEQ ID NO: 213366 - DNA, 932 bp, Homo sapiens
  misc_feature: GYAE6OF01C66JX.36.5.A05.1.454.CMB.1.raw
  modified_base (225)..(225): a, c, t, g, unknown or other
  misc_feature (225)..(225): n is a, c, g, or t
  modified_base (925)..(925): a, c, t, g, unknown or other
  misc_feature (925)..(925): n is a, c, g, or t
  modified_base (928)..(928): a, c, t, g, unknown or other
  misc_feature (928)..(928): n is a, c, g, or t
  modified_base (930)..(930): a, c, t, g, unknown or other
  misc_feature (930)..(930): n is a, c, g, or t
tcagtacgctgtctcacgaccggtgctcgatttagatagatagactagggttggtacacctgtggttcgtcggggctgcccgtttggttttggagatggttttctcgagtgggggctggaggtgggtggcctaacataaaggagatggaagtgaggactactatttggactctgtgaggggccgattccaccgtctccagagacaacgccagaactcagtgctcngcaaatgaacagccctagacgagtccgaaggactacgggtctagtgtacttacctagttacgacgtaacccctaagggattaagttttggaccgtaaaagttcgggggggtttaaactcggaccgttacccgggaccggggggggtacccgtcccgttaggggttaaggaaacgtttcggtaccgtttttttttaggaacccgtaagtttcccgttagggggggtacccccgtaaaaaggggggaacccggtaacggttaccggggttcccgaaaccccgggtttcctttccggtttaccgacggtaccccgtttaccccgaaccccggtaaaacgggggtccccccgtaaagttcccggggtttacccttttcccccccccgttaggggtacccccggtcccccccgtttacgggtacccctttacccccggaaggggaacccggtaccccgtaaccccgttacccccgggaaagggaccggtacccgtaaaccgaaccgggtcccccggacccccggtttcgggggtaacctttccgggtaccccgtttcgggttaacccgaaacgggttaaccctttaaccgtttaccccgtaaaggtaacccaaccgggtccggtttaaccgttaccgggaacgggtacccggggtaccgttacggggaaccgtaacggggacgacctaaaggtacggctggtacngcngncg

SEQ ID NO: 213367 - DNA, 587 bp, Homo sapiens
  misc_feature: GYAE6OF01BG81I.36.5.A05.1.454.CMB.1.raw
  modified_base (454)..(454): a, c, t, g, unknown or other
  misc_feature (454)..(454): n is a, c, g, or t
  modified_base (544)..(544): a, c, t, g, unknown or other
  misc_feature (544)..(544): n is a, c, g, or t
  modified_base (578)..(579): a, c, t, g, unknown or other
  misc_feature (578)..(579): n is a, c, g, or t
  modified_base (581)..(582): a, c, t, g, unknown or other
  misc_feature (581)..(582): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagtacgctgtctcacgaccggtgctcgatttagatagatagacagggtgtacacctgtggttctcggggctgccctttggttttggagatggttttctcgatgggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgccgacctaggatatgacaagtggggttactgccgtccggcgggggcgcgtgggtacgtagtgtcttttgactagtcgtggggaccgaagggacgagtcggtacaccgtctcttcgacgtccctccgaaccgaacgggccctacgtccggtcccttccccgtggcccgtcccgtcgcctccgacggacncccaccgtccgagacgccacgacggccggcccgtggcctcgtccgtggtacaacggtacctaccgttaccgaagtacgacgtacgtacgnggacggccggcgtggacgagggccacgacgtagnnanntgngn

SEQ ID NO: 213368 - DNA, 923 bp, Homo sapiens
  misc_feature: GYAE6OF01CUROX.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacacgccggcctcatctctgcaggtctagtcacacgtcctccttttcagtgatcggaaaacctacctacttagtaagtttggtttacaacgaagacggccaggaccaatcctaccgaacggtcgtacccttaaagttttactacgtaacgggttttacctaaacccggggtaaccttccggttaccggggggttaccccggaactaacggttaacgtttacccggaaagggtccggggtacccgtaagggttacgggggttaccgaacggggtaccctaaaccggtttaggtaaacttttttacccggaaacctaaacggttaacggtaaaaacgttaacccggaagggtaaccccgggttaaggggggtaaagggggtaaaccgggtaccgggttaagggtaaaggggttaacggttttagggggttttaacgggggttttttaaaaccgtttaaccggtttacgggtaccgttaaacggtttacggaaccgggtaaaacggggttaaacctaacggttaaacccggttacggggtacccctttacccggttaaacccggttaccgtttttaccggggacccgggtaaaccgggggtaaacccgtaaaccgggtacggtacggggtaaaacggtaaccgtttaaccccgaaaaaccgggttaaacccgttacggggttaccgggtaccgttaaccggtacccgtaaaccctaacggtttccgttttaacccggg

SEQ ID NO: 213369 - DNA, 617 bp, Homo sapiens
  misc_feature: GYAE6OF01DRFLY.36.5.A05.1.454.CMB.1.raw
  modified_base (607)..(607): a, c, t, g, unknown or other
  misc_feature (607)..(607): n is a, c, g, or t
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtcctccctcgcccgtccacccttggacacgccggcctccactctcctgcaggtctagtcacacgtccttccttttcagtgataggaacaccttacttagtaatttggttacaacagacggccacggccaactctaccgaaggcgtaccttaatttatcgtacggtttactaaccgggtctcggtcgggtaccgactgtactcgagcggcaggtcggtcgacggctacgtgtatttacactactagaaaactcgaagcggtaggggtggaggcgtaggagggtagttagggtttagggtttattacgtgactagtacgacgtaaggtactacgtacgtcgtacccgttacgtacgttacgttacgggacccggaaggggtaccaaggtcgtacggagtaccgtaaccgtaacgttacgttacggcttacgacctaaccgtnttccgttacg

SEQ ID NO: 213370 - DNA, 749 bp, Homo sapiens
  misc_feature: GYAE6OF01EIEE6.36.5.A05.1.454.CMB.1.raw
  modified_base (224)..(224): a, c, t, g, unknown or other
  misc_feature (224)..(224): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctcgcccgtcacccttggacagccggcctccatctcctgcaggtctagtcacncgccttcctttcagtgataggaaactacctacttgaatttggttacaacagacggccaggaccaatcctaccgaagggccgaccttaaattttactacgtaacgggttttaccgtaaacccgggtactccggttcgggggtacccggacgagtacttcgaaggcggacgagggtcgggtacgacggtctaacgtggttaactttacgaacctaacgttaagtaaaacttccgaacggtaccggaagggggttgggaacgggtacgtagggaaggggttaacgtttggggttttaggggggttttaactttacggttaggtaccgtagttacggtaaccgtaaagggttaacctaacgttaaccggttccgggtacccgttacccggttaactttaaccggttttaccgggaacccggtaacgggggaacccgtaaagggtccggttagggaaccgtacgttaaccccggaaacgtaaccgtgggttcgggtaccgttcggaaccctaccgtagttccgttaccgg

SEQ ID NO: 213371 - DNA, 654 bp, Homo sapiens
  misc_feature: GYAE6OF01EA22R.36.5.A05.1.454.CMB.1.raw
  modified_base (393)..(393): a, c, t, g, unknown or other
  misc_feature (393)..(393): n is a, c, g, or t
  modified_base (528)..(528): a, c, t, g, unknown or other
  misc_feature (528)..(528): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtcctccctgcccgtcctacccttggaccacgcccggcctccactctcctgcaggtctagtccacacgtccttccttttcagtgactacggaaactaccgtattagtaatttcggtttacaaactaggacggcacggaccaatctaccgaaggcctactaatttataccgtaggtttaccgaaccgggtactcggtaccggggtcccgacacgtagtcgaggcggacnggttcgggacaacggctaaccgtgtacttaccataacgtaagaaactcgacggtacggtaaggggtaggaggtactacggggtaaggtacgtttagggtttaggggtttacttacgtggtactaagtcggtaaanacgggtatacgtacgtacggtcttacccgtatttacccgttggaccggagggtaacctaggacgtaggacgtactaacccgaaggtaaccgttgggaccgtgtaccgaccaacgttctcgttaccg

SEQ ID NO: 213372 - DNA, 844 bp, Homo sapiens
  misc_feature: GYAE6OF01BAQ2P.36.5.A05.1.454.CMB.1.raw
  modified_base (233)..(233): a, c, t, g, unknown or other
  misc_feature (233)..(233): n is a, c, g, or t
tcagtacgctgtctcacgaccggtgctcgatttagatagatagacagggctgatcaggactcctcagttcaccttctcacaatgagctccctgctcagctccgtgggctgctaatgctctgggtcccagtatcaagcagggatgttgtgatcgactcagtctccacgtcctcccgtcgcccgtccacccgttggaccacggccgcctcactctccgtgcaggtctagtcaacncgtcccttccgttttacagttacgagttacggaaaacctaccctaattagtaacgttttcgtttaacgaaacgaggaacggccctaaccgggacctaaactaccgtacccgaacgggtaccgttaaccttaaattttaagaccgttaaacgggttttaacccgtaaaccggggtccttaccggtacgggggttaccccgaacgtaacgtgtttaccgaggtaccggtacgtaggggttacgggtacgacgggtaccgtacttacggtttaactttaaccaacgtaaccgtaaacgtaaaaacgttaccgtaaagggaccgggtaacgggggttagggaacggtacgggttaacgggttaaacggggtaggttttaagggggttttttaacggggtttttaacggtttaaacgttcgggtaacccgtttaaggtaaccgttaacgggtaaacgggttaaccttaacggttaaccgttacccgggttacccgttaacccgttaccgttaccggttttccggaacgggtaaccgggtaaccgtaacggtacgtacggtagaaccgttaaccgaaacgtacggtaggtcgacgttacacgtaccctgttacccgg

SEQ ID NO: 213373 - DNA, 552 bp, Homo sapiens
  misc_feature: GYAE6OF01CO9NC.36.5.A05.1.454.CMB.1.raw
  modified_base (398)..(398): a, c, t, g, unknown or other
  misc_feature (398)..(398): n is a, c, g, or t
  modified_base (490)..(490): a, c, t, g, unknown or other
  misc_feature (490)..(490): n is a, c, g, or t
  modified_base (532)..(552): a, c, t, g, unknown or other
  misc_feature (532)..(552): n is a, c, g, or t
tcagtacgctgtctcacgaccggtgctcgatttagatagatagacagggtgtacacctgtgtttctcggggctgccctttggttttggagattggttttctcgagtgggggctggagtgggtggccaacataaaggaagatggaagtgaggactactatttggactctgtgaggggccgattcaccgtctccagagacaacgcaagaaactcagtgtctctgcaaaatgaacagcctgagagtcgaggacacggctgtgtattattgtgctaactttcgggattagttggaccgacgcgcaagtggggccacgggaaccctggtcaccgtctccctcacgcctccaccgaacgggcccacgtcggtccttcccccgtggccgcccctgcctccagggnaccaccctccggagacgcacacggcccggcccgtgggcgttcgccctgggtaccgaaaggtacctaccttaccgacgacgacgtccggtacngggtaaggcccgggtctcggggcgaacgggcgacgactaggnnnnnnnnnnnnnnnnnnnnn

SEQ ID NO: 213374 - DNA, 743 bp, Homo sapiens
  misc_feature: GYAE6OF01CA0RU.36.5.A05.1.454.CMB.1.raw
  modified_base (551)..(551): a, c, t, g, unknown or other
  misc_feature (551)..(551): n is a, c, g, or t
tcagtacgctgtctcacgaccggtgctcgatttagatagatagacaggggtgatcaggactcctcagttcaccttctcacaatgaggctccctgctcagctcctgggctgctaatgctctgggtcccagtatcaagcagggatgttgtgatgactcagtctccagtctccctgcccgtcacccttggcagccggcctccatctcctgcaggtctagtcacagtcctcttttcagtgataggaaactaccttacttgaatttggtttacaaacaggaggcctaggacctaaacttccctaacgacggtaccgtacgtttaactttacgtacggttacggtttacccggtaaccgggtaccgttacgggtccggggtacccggaagtaacggtacgttacgacggacggtacggtaacgggttcgggtaccgaggtaccctagttacgttaacctttaccgaacctaacgtaaacgtaactcgacggtacgggtaggggtagggaccgtgtaagggtaagggttacggttttaggggtttaacgggttttaanacggttacgacgtagtacgtaagtaacgtaactaccggttagtacccgggtacccttaccgttagtttacccggttcgggaacccgggtaacggaaccgtacgggacggttaacgggaaccgttaacctaaacccggaaaccgttggttacgggtccggtacgttccaaacccgttctacgttccgttacgg

SEQ ID NO: 213375 - DNA, 771 bp, Homo sapiens
  misc_feature: GYAE6OF01C3JIO.36.5.A05.1.454.CMB.1.raw
tcagtacgctgtctcacgaccggtgctcgatttagatagatagacaggggtgatcaggactcctcagttcaccttctcacaatgaggctccctgctcagctccgtggggctgctaatgctctgggtcccagtatcaagcgagggatgttgtgatgactcagtctcctagtcctccctcgcccgtccacccttggacacgcccggcctccactctcctgcgtaggtctacgtcactacgtccttccttttacgagtgtacgtacggaaaacctaccttaacgtttagtaaacgtttggtttaaccaaacgtaggacggaccgacggaccctaaacgtccgtaccgaacgggtcctaacctttaaattttactaccgtacgggttttacccgaaccgggtacgttccgggttacggggaccccgtagtaacgtagttaccgacggtaccggacgtagggtcgggtacgacggctacgttgtactttaccactaacgtaagaaagtcgacgtacggaggggtaggaggtcgtaggacggttagttgggtttagggttttactacgtagtacgtataggaacgtaaggttaactaacgttaccggtcgtacccgttaccggttaaccgttacgggttttaccgggaacccggtaacgggggtaaacccgtaaagtccgggtaacggtaaacgtaaccgtaaccccggttaaaacggaccggttgggtacggtaccccggttagtacccgtaaacccgtagtttcccgttaaacgg

SEQ ID NO: 213376 - DNA, 903 bp, Homo sapiens
  misc_feature: GYAE6OF01C7AY0.36.5.A05.1.454.CMB.1.raw
  modified_base (176)..(176): a, c, t, g, unknown or other
  misc_feature (176)..(176): n is a, c, g, or t
  modified_base (216)..(216): a, c, t, g, unknown or other
  misc_feature (216)..(216): n is a, c, g, or t
tcagtacgctgtctcacgaccggtgctcgatttagatagatagacaggggctgatcaggactcctcagttcaccttctcacaatgaggctccctgctcagctcctggggcctgctaatcgctctgggtcccagtatcaaggcgagggtatggttgtgatagtactcacgtcctccncgtccttcccgtcggtcccgtccgtaacccgttggaaccncggcccggtcctcctagtccctccgtagacgtacggttactagtccaactaacggtcccttttacttttaccgaggttacgaagtaaccgggtaaaacctacctttaaacgttagtaacgtttacggggtttaaccaacgtaacgggacggaccgacggtaaccaacgttaccgtaccggaaacggtccgtaaccgtttaattttaaccgtaccgtttaacgggttttaacccgaaacccgggggtctttaccgggtaccggggtaacccggtactacggttaacgttccggaacggccgggtacgtagggttcgggaccggtaaggcctacgtaggttacctttacgaacgtaacgttaacgaaactcggaacggacggtaggggaacgggtgtaaccggtagggttacgggtaggtttagggttttacggggtttaactacctaggttcgaagttacgtaacggttaacgttaaccgtacggttaccgttacccgggccgttttaaacccggggttaactttcccggggtacgggttaacccgggaaaacgggttaacccggtaaaccggcggtttaaaccggggtataacccggttaaaacccgggtaacgacccggggttttacggtaaccccgggttaacccgtttacggaaaccccgtttacccgtaggtttttaaccccg

SEQ ID NO: 213377 - DNA, 770 bp, Homo sapiens
  misc_feature: GYAE6OF01CDBKB.36.5.A05.1.454.CMB.1.raw
tcagtacgctgtctcacgaccggtgctcgatttagatagatagacaggggtgatcaggactcctcagttcaccttctcacaatgaggctccctgctcagctcctgggctgctaatgctctgggtcccagtatcaagcagggatgttgtgatgactcagtctccagtcctccctcgcccgtccacccttggacacgccggcctccatctcctgcaggtctagtcacacgtccttcctttcagtgatacggaaactacctattagtaagtttgttacaacagtacggaccaggaccaatcctaccgaacggccgtaaccttaagtttactcgttacggtttaccgtaacccgggtactccggtacgggggtaccccgaacgtacggtactttaccgaagggccggtacgtacgggtcgggtaccgacgggtacctacgtagttacctttaccgaaaccgtaacgttaacgtaaaacgttccgaaaggtccgggtaagggggtacgggaacgggtacggttacgggtaaaggggttaacggttttacggggtttttacgggggttttaaactttacggtacggtacgtaaggtttaccggaacgttaaacgggtacctaacgttacccggtaccgtacccggtttacccgttacgtttaccggtttacgggaacccggtacggggtaacctacggtacgtacgggtaactaaccgtaacccgtaacggtaacgttcggtacggtactacgtacccgaccgttgtccgttaccg

SEQ ID NO: 213378 - DNA, 623 bp, Homo sapiens
  misc_feature: GYAE6OF01BGQEA.36.5.A05.1.454.CMB.1.raw
tcagtacgctgtctcacgaccggtgctcgatttagatagatagacaggggtcagagaggagccttagccctggactccaaggcctttccacttggtgatcagcactgagcacagaggactcaccatggaattggggctgagctgggttttccttgttgttattttagaaggtgcccagtgtgaggtgcagttggtggagtcgtgggggaggcgttggtccaggccgggggggtccctggagactctcctgcgcagcgtctggattcgtaggtttagtggctagttggtatggagttggcgtccgccgaggcgtccgggaggggggggcgtgggaggtgggtcggccaacgaagtaaaggaagagtaggaaggtgaggactactagtttggactgtgtggagggcgtattcgacgtctcgagacgacgaacgccgaagaactgacgtcgtctcgtagactaaatacgtaacaggtcctagacggtacgtcggaacggacgacggtacgtgttagttaattacgtaggtacgaccgtaacccgtaggtaacgttagttcggacgttaagggttcgggggttacttcggtccggtccggggaccggggcgtacggtgggtgtacgg

SEQ ID NO: 213379 - DNA, 909 bp, Homo sapiens
  misc_feature: GYAE6OF01AEZJ5.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtcctccctgcccgtctacccgtggacacggccgccctccatcctcctgcaggtctacgtccactacgtcctttccttttcagtgacgtacggaaacctaccgttaagttagttaacgtttggtttaccaaacgtacggacggacccgaacgggacccctaacgttacccgtacccgaaacggtaccgtacctttaaagtttacgttaccggttaaccgggttttacccggtaaacccggggtaccgttccgggttaccgggggttaccccggaagaaccggttacgttaccggaacggggtaccgggtacgtaaggggttcggggtacgaacggggtacctaccggttaagttaccgtttaccgaaccgtaacgttaacgtaaaactcggaaagggtccgggtaagggggttacgggaacgggttaggtacggggtaagggtttaggttttaggggttttacggggtttttaacgttaacggttggtaaccgttacggttaacgggtaacccgggttaaaaggtttaaccctaacggtttaaacccgggttccggtacccccggttttaaacccggtttaccggtttaaccgggttttaccggggaacccccgggttaaacgggggtacccgttaaacgggtcgggttaaccgggtaaaccgttaccggtaacccgttaaaccgggtaacggtttcggtaaccgggaccttaccgggtaaccctaacggttacgtttcccgg

SEQ ID NO: 213380 - DNA, 747 bp, Homo sapiens
  misc_feature: GYAE6OF01DXEKS.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtcctccctcgcccgtacaaccgttggaccacgcccggcctccactcctcctgctaggtctagtcactacgcccttcttttcagtagatacggaaacctaccttaacgttgtaactttcggttacaaaccgtaggaccggtccgaacggacctaaacgtccgtaccgaaacggtccgttaaccttaagttttacttcgtaacggtttaccgtaaccgggtcgtccggttcggggtacccgagtcgacgttcgacggtcggtcgtagggtcgggtacacggtcctagtacgtacgtttaccaacgtaccgttaagaaacgttaccgaagggtacggtacggggggttaacggagggtaccgtagggtaagggtacgggttttgggtttaaccggggtttaattacggttggtaacctagtacggtaacggtaaggtaaccgtagttacggtaccggtaccccttacccgtttacggtacggtttccgggaccggtaacgggaccctaggtacgggtaacgtacggtacctaaccggaaaccggttgtaccggttaggacctaccggacctactacggttccg

SEQ ID NO: 213381 - DNA, 833 bp, Homo sapiens
  misc_feature: GYAE6OF01DXEBX.36.5.A05.1.454.CMB.1.raw
tcagtacgctgtctcacgaccggtgctcgatttagatagatagacaggggtgatcaggactcctcagttcaccttctcacaatgaggctccctgctcagctcctgggctgctaatgctctgggtcccagtatcaagcgagggatgttgtgatgactcagtctccagtctccctgcccgtcacccttggacacgccggcctccatcctcctgcaggtctagtccacagtccttccttttcagtgatacggaaactaccttattagtaatttggttacaacgtagacggccaaggcctaaatccgtaccgaagggtccctacctttaaacttttactaccggtaagggttttacccgtaaacccggggtacttacccgggttcgggggtacccccgtaagtacggtacgtttccgaacgggtccgggacgtagggttacggggtaccgagggtacctaccgtaggttaacttttccgaaaccgttaacgtaacggttaaaaacgttaccggtaaaggggtttaaggggttacggggtaacgggtacgttaggggtaacgggttagggtttacgggtttttagggggttttaacgttttaaccggtagttaccgtaaggttcgggtaacgtaaacgggttaaccgttaacgttaacccggtccggttaccctttacccggttaacgtttacccggtttttacggggaccccggtaaagggggtaaccccgtaaggtaccggttacgggtaacgtaaacccgttaacccgaaacggttaaccgttcgggttacgtacccgtacgaccctaacccttacgttccgttcgtttaccccg

SEQ ID NO: 213382 - DNA, 772 bp, Homo sapiens
  misc_feature: GYAE6OF01B8UQS.36.5.A05.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
tcagtacgctgtctcacgaccggtgctcgatttagatagatagacaggggctgatcaggactcctcagttcaccttctcacaatgaggctccctgctcagctcctggggctgctaatgctctgggtcccagtatcaagcgagggatgttgtgatgactcagtctccagtctccctgcccgtcctacccttggacacgccggcctccatcctcctgcaggtctagtcacngcccttcctttcagtgatggaaactacctactcgtaattggtttacaanacgacgccaggtccaatctaccgaaggtcctaccttaatttacgtcgttaacggtttaccgtaacccgggtactacggttcggggtacccgacgtagtacgttccgaaggtccgggactagggttcgggtaccgacgggtcgtaccgttaggtaaactttaccgaactacccgttaaggtaaaacgtaccgtaacgggaccgggtaacgggggttacggggaacgggtaacggttagggttaaaggggttacgtttagggggtttttaaggggttttaacgtttaacgttacgtacgtaacgttacgtacggttaaacggtaacgtaacggttaaccgtccgggttacccgtttaacccggtttacggttaaccgttttaaccggggacccggtaacggggtaaccgtaaccggtacgtaccgggtaacgtaaccgtaacccgaaccggtaaacgttcggtaaccggtacgtaccgaccgtaccgtacgttccg

SEQ ID NO: 213383 - DNA, 705 bp, Homo sapiens
  misc_feature: GYAE6OF01DR8K5.36.5.A05.1.454.CMB.1.raw
tcagtacgctgtctcacgaccggtgctcgatttagatagatagacaggggtgatcaggactcctcagttcaccttctcacaatgaggctccctgctcagctcctgggctgctaatgctctgggtcccagtatcaagcagggatgttgtgatgactcagtctccagtcctccctgcccgtcacccttggacacgccggcctccatctcctgcagtctagtcacacgtccttccgttttcagtgatacggaaaacctccttacttagtaagtttcggttacaacgtagaggccacggaccaatcctaccgaacggcgtacctttaattacgtacgtacggtttaccgtaaaccgggtacttccggtcggggtacccggacgtagtacgttacgacggtcggcgtagggttacgggtcaacggcctacgttacgtactttaccgaacgtaaccgtaagaaaactccgaggtacgggtaaggggttagggacggttcggtaagggtaagggtgttttaggggtttaggggttttaattccgtaggtacgtagtagacgtaaagtacctagttaccggtcgtccgttaccgttaacgttacgtttcgggaccggtaacgggtacctaagggtcgtacgggtaaacgtaacccgtacggtaaaaccgtacgtcgggtacggtcctacgaccctaccgtacttccgttaccg

SEQ ID NO: 213384 - DNA, 728 bp, Homo sapiens
  misc_feature: GYAE6OF01CJTGV.36.5.A05.1.454.CMB.1.raw
tcagtacgctgtctcacgaccggtgctcgatttagatagatagacaggggtgatcaggactcctcagttcaccttctcacaatgaggctccctgctcagctcctgggctgctaatgctctgggtcccagtatcaagcgagggatgttgtgatgactcagtctccagtcctccctcgcccgtctacccgttggacgacgcccggcctccactcctcctgcgaggtctacgtcacacgtccttccttttcgagtgtaatacggaaacctaccttaacgttagtaagttttcggtttacaacgaggacggaccaacggaccaactccgtaccgaacgccgtaccttaatttacgtacgtacggtttaccgtaaccgggtacctcggtacggggtcccgaagagtactcgcggtcgacgtaggtcgggtcgaggtctacgtagtacttacactaacgtagtaaactcgaacgacggtaggggtaggacggtacggtagggtaaggttacggtttagggttttaggggtttacttacgtagtagtacgtagtaacgtaacgggttaactaactccgggttaccggtaccctttaccgggttaaccgttcggttttacggaaccccgggacggggaaccgtaaaggtcggtaacgggtacggtaacccgtaaccggtaaaaccggtacggttaggtccgggtactaccggtacctacctacggttctttcccgg

SEQ ID NO: 213385 - DNA, 738 bp, Homo sapiens
  misc_feature: GYAE6OF01EMSLH.36.5.A05.1.454.CMB.1.raw
  modified_base (132)..(132): a, c, t, g, unknown or other
  misc_feature (132)..(132): n is a, c, g, or t
  modified_base (242)..(242): a, c, t, g, unknown or other
  misc_feature (242)..(242): n is a, c, g, or t
tcagtacgctgtctcacgaccggtgctcgatttagatagatagacaggggtgatcaggactcctcagttcaccttctcacaatgaggctccctgctcagctccgtgggctgctaatgctctgggtcccagtntcaagcagggatgttgtgatcgactcagtctccagtcctcccgtcgacccgtcgacccttggacacgccggcctccatctcctgcaggtctagtcacagtccttcctttnacgtgactaggaaacctaccttacttagtaagttggttacaacgtaggcgtcgaacgtccaatcgtaccgaaggtccgtaccttaaagtttacgtacctacgggttttcctaaaccggggtcctccggttacgggggtaccccgaagtacggtacgttacgaacggtccggacgtaggtcgggtacaagggctaccggttagtacttaccgactaataacggaaattccgaagggtacgtaggggtagggaacggtcggttaacgggtaggttacgttgggtttacgggggttttacttacggtcgtaaccgtagttggaaccgtaaggtaccgttaaactccgttacgggtacccctttccggttaacgttaccggttttaccggaacccgggtttaaggaacccgtaaaggtcccggtaagggtaacgttacccgtaacgttaaaccgggacgtttggaccggtactacgaccgtacctcgttaaccggttcgg

SEQ ID NO: 213386 - DNA, 754 bp, Homo sapiens
  misc_feature: GYAE6OF01CN3F0.36.5.A05.1.454.CMB.1.raw
tcagtacgctgtctcacgaccggtgctcgatttagatagatagacaggggctgatcaggactcctcagttcaccttctcacaatgaggctccctgctcagctccgtgggctgctaatgctcgtcgggtcccagtatacgaagcgagggtattggttgtgagtgactctacgtcctacctacgtccctcccgtccgcccgtacctaccgtcggacgccgcccgtcctaccgtactcctccgtgcgtaggtactacgtacaacctcgtcctttctttacgagtagtaacgtaacgtaacctaccgttaacgttggttaagttacggttaccaaacggtacggtaccggccgtaacggtacctaacgttaccgtaaccggtaaccggtaccgttaaccttttaaacggtttacggtacggtttaacccggggtttaaccgtaaacccggggtccgttaccggggtccgggtaacccgaacgttagtaccgttacggaccgggcggtacggtagggtcggacgacgtcctaagtcgttacttacgactacgtaaggtaacgtgaggtacgggaggggtaggtacggtaggtaagggttcggtttagggtttacggggttttacggttatcgaagtcgtagtaacgacgtaaagtccgtacgttccggtcgtaccttacgttacgtcggtacggaaccgtcgaacgagtcgtaaacggactactaacggacgttgacggtcacctcaactccgtcttcg

SEQ ID NO: 213387 - DNA, 716 bp, Homo sapiens
  misc_feature: GYAE6OF01EOWFT.36.5.A05.1.454.CMB.1.raw
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
tcagtacgctgtctcacgaccggtgctcgatttagatagatagacaggggtgatcaggactcctcagttcaccttctcacaatgaggctccctgctcagctccgtgggctgctaatgctcgtcgggtcccagtatcaagcagggatgttgtgatgactcagtctccagtcctccctcgtccctcgtacccgttggacacggcccgtcctccacttcctcctgcgtaggtcctagtccaccacgtccctttcctttcagtagagtacgaaacctaccttagtagtagtttcggttacaacgtaggacgaccgagtaccaatccgacgacggacctacttaatctcgttagttaccgaacggtctccggtacgggcccgangtactcgaggtccgagtagggtcggtaaccgngtcctagtcgtaacttccaacgtaataacgtaactacgacgtacggtagggtaggtaggacgtagggtaaggtaggttttagggtttacggtttacgttaacgttggataacggtacgaacgttaacgtacgttaacgttaccggttcccggttacccgtttaaccgtttaccgttacggttttaccgggacccgggtaacggaacccgtaggtaccgggtacggtaacggtaacgttaaccggtaaccggtaacggttacggaccggtaccgtacgtacccgtaaccgttccgttacgttcccg

SEQ ID NO: 213388 - DNA, 881 bp, Homo sapiens
  misc_feature: GYAE6OF01EAH6Q.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtctccctcgcccgtcacccttggacacgccgctccatctctgcagtctacgtcacacgtccttcctttcgagtgagtacggaaacctaccttacgttagtaagtttcggtttaacaacgtaacggacggacccgaacggaccctaaacgtccgttaacccgaaacgggtccgtaacctttaaagttttactaccgttaagggttttaccccggtaaaaccgggtccgttccgggtaccgggggttaccccggaacgtaacggttactttaccgggacgggtccgggtacgtaaggggttccgggtacgacgggtaccacgtttaggttacctttaccgaacgttaacgtaacgtaaaacgttccggaaggtacgggttaagggggtaggtacgggtacgttaagggtaggggtttaacggttttcgggggtttttaagggttttaacgttacggttacgtaccggttaagttacccggtaaacggttaaacgggttaacctaaacggtttcccggttaccggttaccccggtttaacccggtttaacggtttacccggttttccggggaaaccggggttaaaccgggggaaacccttaaacgggttccgggttaaacggtaaccgttaacggtaaacccccggtaaagggttaccgttacggggttaccggtaccgttaacccggtaccccgttaaggttcccgtttaacccgg

SEQ ID NO: 213389 - DNA, 606 bp, Homo sapiens
  misc_feature: GYAE6OF01CIAYT.36.5.A05.1.454.CMB.1.raw
  modified_base (449)..(449): a, c, t, g, unknown or other
  misc_feature (449)..(449): n is a, c, g, or t
  modified_base (594)..(595): a, c, t, g, unknown or other
  misc_feature (594)..(595): n is a, c, g, or t
  modified_base (598)..(598): a, c, t, g, unknown or other
  misc_feature (598)..(598): n is a, c, g, or t
  modified_base (600)..(606): a, c, t, g, unknown or other
  misc_feature (600)..(606): n is a, c, g, or t
tcagtacgctgtctcacgaccggtgctcgatttagatagatagacagggtgtacacctgtggttctcggggctgccctttgggttttggagattggttttctcgagtgggggctggagtgggtggccaacataaaggaagatggaagtgaggactactatttggactctgtggaggggccattcaccgtctccagagacaacgccagaaacctcactgtatctgcaaatggacgcctggagactccgaggacacggctgtagtattatgtgcgagagtatttagactaacaaagtttcgagtgacgtggtatgatgtcttagtagtactaccggtggggccgaaagggacctagtcggtccaccgtcttcttcacgtccctaccaccgaacgggccctacgtccggttcccttcccccgtggccctcccgtcgtcctaccgaggtaccnccgaaccgtccgaagcccgacaccgacggccccgggcccgtgggccttccggcctagggtacgaacggtaccttacctcgaacggcgacggttcctacggttcggacgggtccgggtagtccgggacacgggtcgcgtaagtgcnncgncnnnnnnn

SEQ ID NO: 213390 - DNA, 928 bp, Homo sapiens
  misc_feature: GYAE6OF01CUTN8.36.5.A05.1.454.CMB.1.raw
  modified_base (245)..(245): a, c, t, g, unknown or other
  misc_feature (245)..(245): n is a, c, g, or t
tcagtacgctgtctcacgaccggtgctcgatttagatagatagacaggggtgatcaggactcctcagttcaccttctcacaatgaggcctccctgctcagctcctggggctgctaatgctctgggtcccagtatcaagcagggatgttgtgatgactcagtctcagtcctccctcgcccgtcacccttggacacgcccggcctaccatctcctgctaggtctagtccacacgtcccttccttttnagtagagtacggaaacctaccgttacttagtaagtttcggttacaacgaggccggaccgaacggaccctaactccgtaccgaacggtccgtaaccctttaattttacgtaccgttacggtttaacccgttaaaccgggtccgttaccggtacgggggtacccccgaagtacgtacgttacgacggtccgggacgtaagggttccgggtaaccgacgggtaaccctaaccgttagggttaaccttttaacccgaaaccgtaaacgtttaaaggtaaaaccgttaccggtaaaggaccggggtaacgggggttaggggtaaaccggggtaccggtttaacggggtaaaggggtttaaggttttacgggggttttaaaccgggggttttttaagttaacccggtttacggtaccggttaaaggtttacggtaaaaccgggtaaacgggtttaaccgtaaaccggtttacccggttaaccggggtttaccccccgttaaccgggttaaccgttttaacccggggttttaccgggaacccccggggtaaacggggtaaacccccgtaaagggttacccgggtaacggggtaaccgttaaaccccgtaacccggtaaacccggttaacggtacgggtttaccggaccttaaccgggaccctaaacccggtagtttccccggtttacccg

SEQ ID NO: 213391 - DNA, 880 bp, Homo sapiens
  misc_feature: GYAE6OF01EC66W.36.5.A05.1.454.CMB.1.raw
  modified_base (796)..(796): a, c, t, g, unknown or other
  misc_feature (796)..(796): n is a, c, g, or t
tcagtacgctgtctcacgaccggtgctcgatttagatagatagacaggggtgatcaggactcctcagttcaccttctcacaatgaggctccctgctcagctccgtggggctgctaatgctcgtgggtcccagtatcaagcgagggtatggttgtgactgactcgagtcctccacgttccctcccgtcgtcccccggttaccaccccgttcggaaccgaccggcccccgggtccccttacctacttccctccgtcgtacggtaccggttacgtacgttaaccgtaaccgtacccggttccctttttccgtttacgtaacggtacggttaaccggtaaacggtaaaaccccttaccccgtttaagtttaaggtttaacggttttaaccgtttaccgaaaacggtacggaaccggtaacccgaacggtacctaaccgtttccgaaccggtaacgggtaccctacttttaaatttacggttaccgttaccggtttaccggtaacccggtcgttaccgggttcggggtacccgtaatacgttacgtccggtaacggcccggtagtacggggttcggaacgtacgaccgttacgtaacgttaccgtaactaacggtaacgttaaaacgaactacgtacggaacgggtaggggtaagggtcggtaggtacggtagggtttaggtttaggggttttacggtttaagttacgtacgtacgtagttacgtaacgttaacgacgttacgtaaccgtcggttaccgttaccgttacgttaccggttacggaaccggtaggtaaaccgnggttaaccggaggttaaccgtaacgtaccgtaaaccggttacgtgggtaccgtcgttacggaccgtaccgttgttccgtttacg

SEQ ID NO: 213392 - DNA, 802 bp, Homo sapiens
  misc_feature: GYAE6OF01EJ8YF.36.5.A05.1.454.CMB.1.raw
tcagtacgctgtctcacgaccggtgctcgatttagatagatagacaggggtgatcaggactcctcagttcaccttctcacaatgaggctccctgctcagctccgtggggctgctaatgctcgtcgggtcccagtatcaagcgagggattgttgtgatgactcagtctccagtcctccctcgcccgtcctacccgttggaccgacggcccggccctacctacttccgtcctcgacgtacggtactacgtccacacgttccctttccttttacaggtagtacgtaacggaaaacctacctttaacgttaggttaacgttttcggttaacaaacgtaacgggtacggaccgaacggtacccaaacttcccgtaaccggaacggtcccgttaacctttaaagttttacgtaccggtttaacggttttaccggtaaacccggggttacgttaccggggttacccgggggtacccgtaaacgaacggttaacttccgggacgggtaccggtacggtaagggttcggggtacctacgggtactaacgttaggttactttaccaacgtaacgttaagtaaacgtacgacggacggtaggggtacgggaaggtcgtaaggtacggttaggtttaggggtttacggttttaacgtacgtgtacgtagtacgacgtaacggtaactacgttacgtccgtaccgttacccgttacgttacgtttacgggaaccgtaacggggaacgtacgtacggtcggaacgtacgtaaccggtaacgtacgtggtacgtactaccgacgtactgtcgttacg

SEQ ID NO: 213393 - DNA, 928 bp, Homo sapiens
  misc_feature: GYAE6OF01CH84N.36.5.A05.1.454.CMB.1.raw
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (921)..(921): a, c, t, g, unknown or other
  misc_feature (921)..(921): n is a, c, g, or t
  modified_base (925)..(925): a, c, t, g, unknown or other
  misc_feature (925)..(925): n is a, c, g, or t
tcagtacgctgtctcacgaccggtgctcgatttagatagatagacagggtgtacacctgtggttctcggggctgtcccttttggttttggagattggttttctcgagtggggggctggaggtggggtggccaaacataaaggaagatggaagtgaggactactatttggactctgtggaggggccattcaccgtctccgagagacaacgccaagaactcagtntctctgacaaatgaacngcctgagacgtcggaggaccgcggtctagtgttacttacgtgtcgaccgtaaccgtaggtaattagttcggacgtaagggttcgggggttacctcgggtacccggtccgggggcggggggtccgtacggttagggttaacggtacgttcgtttacgttttacggaaccgttaggttaccggggtacgggggaaccggaaacggggtacgtacggttccggtacccgttaccgttccttacccgttaccgaccggtcccctaacccggaacccggtaaccggggtaccccttaccgggtttccccggtttccccccgttacccccggtcggtacccccggtccccgttacggtaccccgtaccgggtaaccgggacccgttaacccccgtacccgggtaaccggaaccgtaccggtaccccgaaccgggtacccgggtccccccggggttacccgggttaccggggtcccggttcccgggttaacccgggttaaccggggtaacccggtaaaacccggtttacccgtttaaccccgttaccgggaaaccggtaacccggaaccggggtttaccgggtaacccgggttacgggggaacccggggtcccgggggtaacgggtaccggggaaccccgggtaacggggtacccggtaaccggttaggaccgtagtacggcaacgtnacgngtg

SEQ ID NO: 213394 - DNA, 710 bp, Homo sapiens
  misc_feature: GYAE6OF01DYJGN.36.5.A05.1.454.CMB.1.raw
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
tcagtacgctgtctcacgaccggtgctcgatttagatagatagacaggggtgatcaggactcctcagttcaccttctcacaatgaggctccctgctcagctcctggggctgctaatgctcgtgggtcccagtatcaagcgagggatgttgtgatgactcagtctcctagtcctccctcgcccgtccacccttggacacgcccggccctccactcctcctgcgaggtctagtccactacgtccctttccttttacagttgaacgtaaggaaacctaccttaacttagtaagtttcgtttaccaacgacggacggacctacggacctaacgtccacgacggacttacttatactacgttacgttaccgtaacggtcgtcggtcggaccgatagtnacgngcgtcgnggtacgcgacgtntacgtnttacgtactaactacgtaataagacgaggaggtacgggtagacgttaggagggtacggtttagggtttggttttacggtttaatagtcgtaattacggtaaggtaacgaacgttacgtagttaccggtacccgtttcccgttaaacgtttaccggttttaacggggttaccggaaacccgggacggttaaacccggtggttacggtaaagggtacccgaaccgttaaccggaaaccggtttgggtacggtacctcggtcccttaaacgccgttaccgtttgtccccg

SEQ ID NO: 213395 - DNA, 783 bp, Homo sapiens
  misc_feature: GYAE6OF01BYV38.36.5.A05.1.454.CMB.1.raw
tcagtacgctgtctcacgaccggtgctcgatttagatagatagacaggggtcagagaggagccttagccctggactccaaggcctttccacttggtgatcagcactgagcacagaggactcaccatggaattggggctgagctgggttttccttgttgttattttagaaggtgcccagtgtgaggtgcaggttggtggagtcgtgggggagtcgttggtccgagggcccgggggggtccctaggacgactctacctggcgcgagcgtcgtcggtattacgtaggtttagtggtacttagttggattggtagttcggccgtccgaccgtacggtccgtaccggggagggggggtctaggggtacggtggggtacggacgaaacgaacgtaaaagggaacgagtaggaagtaggaacggtaacgtaactaagtttacggacttcgttagggtagggacgggtaccgtacgttaccgtacccgttacctaccgaaggtaacgaacgtaacccgacctaaaggtaaccccttagaacgttcgttccgtacgttacggaacgtaaaagtcggaaactaccggtaaccggttaggaaacgtacgggtaccggaaacggtaacggtacccgggtagtttagtacgttaatttaccgtacgggttaccgaccggtaacccggttaggaactttacggttaacgtaacggtaagggttttaccgggggttaacctcggttcccggttacccgggggaccgggggttacgacggttaggggtaacgttacggg

SEQ ID NO: 213396 - DNA, 768 bp, Homo sapiens
  misc_feature: GYAE6OF01AY9Y9.36.5.A05.1.454.CMB.1.raw
  modified_base (755)..(755): a, c, t, g, unknown or other
  misc_feature (755)..(755): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtcctccctcgtcccgtcctaccccttgggaccacggcccggcccttaccattcctcctgtctaggtacttagtccgactacggtccctttcctttttacacggttgaagtacggaaaacctacccgtttaaccgtttagaacgtttttagggtttaccaaaccgaacggacgggtacccaacgggtaacccctaaagttcccgtaccgaacggtcccgttaacccttaaattttacgtacgttaaccggttttaccgaaacccgggtacgtccggttaccgggggtaccccgaaccgttagaacgttccgaggtcggacgtaggtcggtacgagtccacgttagtacttactaccacgtaagaaactcgacggacggtagggtagggtacggtacggtaggagggttaagttgggttttaaggggttttacttaacggttgtacgtaaggttacgacggtaacggtacgtaacggttaccgttacgtcccgtttaccgttacgtttaccggtttaggaaccggttaccggaaccggtagtaccgtggaaccgtaacgtaccctaacggaacttggcggtactacggacncctagtacgttcc

SEQ ID NO: 213397 - DNA, 750 bp, Homo sapiens
  misc_feature: GYAE6OF01BA3UD.36.5.A05.1.454.CMB.1.raw
  modified_base (210)..(210): a, c, t, g, unknown or other
  misc_feature (210)..(210): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtcctcagtctccctcgcccgtcacccttgacacgcccggcctccatctccngcagtctagtcacagtcccttccttttacagtagataggaaaccacctacttgtaattggttacaacaggacgaccaggaccaatctaccaacgggcgtaccttaatttactcgtaacggttttccgaaaccgggtacttcggacggggtacccgaacaggtacttacgagcgggactaggtcgggtacaaggctactagtactttaccaactagtaacaaacgtacgaacgtacgaaggggtacgggaagggtacgtaggtaagggtaacggtttagggttttaagggggttttaactttaacggtacggaacgtacgttaacggaccggttaaagggtaaccctaaggttaaccgtacgggtaccccgtttacccgttaacgttaacccggttttacgggacccgggtaaacgggggtaaacccgtaaacggtacccggtaagggtaaacccggtagttaaacccccggtaaacggtaaaccggttcggtaccgggtaccgttacggtaacccgtaacccgtacgtttccgttaacgg

SEQ ID NO: 213398 - DNA, 768 bp, Homo sapiens
  misc_feature: GYAE6OF01CLGPX.36.5.A05.1.454.CMB.1.raw
tcagtacgctgtctcacgaccggtgctcgatttagatagatagacaggggtgatcaggactcctcagttcaccttctcacaatgaggctccctgctcagctccgtgggctgctaatgctcgtcgggtcccagtatcaagcgagggattgttgtgatgactcagtcctcagtcctccctacgcccgtcctaccgttggacctacgcccgccctctacttcctctgcacggttctacgtcaccacgtcccttctttcgagtagactacggaaacctacgttacgttagttaagtttcggttaacaagacggtacgaccgacggaccttaacgtccgtaaccggaacggtaccgttaacctttaagtttacgttaccggtacgggttttaacccgaaacccgggtctcccggggttaccggggaccccgagttaacgtacgttacgacgggtacggtacgtacggggtacggtccgaacggtcctaaaccgtttgtaaacgtttaccaaacgtacgtaaacgtaaacgtcggacggaacggtaggggttacgagtcggtagaacggtttgtttacgggtttaggtcctacgtcgtaacgttagacgtaacggtaacgttaacgtcgttaccggtttccgaccgttttaaccgcgttttaacgggtccgaacggtaacgggacctaaggtcggtaacggttaaacgaaccttaaccggtacgttcgttagggacccgttaacgtcaaccctttaaccgtgtttcgttaaccg

SEQ ID NO: 213399 - DNA, 907 bp, Homo sapiens
  misc_feature: GYAE6OF01DFA5X.36.5.A05.1.454.CMB.1.raw
tcagtacgctgtctcacgaccggtgctcgatttagatagatagacaggggctgatcaggactcctcagttcaccttctcacaatgaggctccctgctcagcctccgtggggctgctatgctcgtcgggtcccagtatacaagcgaggatggttgtgatgactcacgtctcctgtcctccctcgcccgtcctacccgtggacgacgcccgtccctcctactcctcgtacgcgtacggttactaacgtaccacctaccggttccctttccttttacgaagttacgtaacgtaaacggtaacctaccgttaacgttagttaacgtttacggtttaacaaacgtaggaacggacccgtaacggaccctaaactccgttaaccggaacgtaccgttaacctttaaattttaccgttaaccggttacgggttttaacccgggtaacccgggttacgttaccggggttacccggggtaacccgtacgtacggttaccgttacggacgggtccggtacggttaacgggtcgggtaacgacggtaccgtaacgttacgttaacctttaccaacgttaacgttaaacggtaaacttaccgggaagtacgggtaagggttagggacggtacggttaagggtacgggttaaggtttttggggttttaaccgggtttataaccgtcgggtacgttaaggttaccggtaaacggtaggtaaaccgttagggttacccgtaccgggttaccccttaacggttttaaccgttacgggtttaccggggtaaccccggaggggtaaacccgttaacgggtacggttaacgggaaaccgttaaccgggtaaaccctaaacggggggtttccctagggggtttacccggaaccgttaaggacccccgtttaaggttacctttcccgg

SEQ ID NO: 213400 - DNA, 791 bp, Homo sapiens
  misc_feature: GYAE6OF01CRC2C.36.5.A05.1.454.CMB.1.raw
tcagtacgctgtctcacgaccggtgctcgatttagatagatagacaggggctgatcaggactcctcagttcaccttctcacaatgaggctccctgctcagctccgtggggctgctaatgctcgtgggtcccagtatcaagcagggatgtgtagatgactcacgtctccagtcctccctcgcccgtcctaccgttggacacgcccgtcctccatcctcctgactacgtacgtactcacctacgtccctttccttttacgagttacgacgtaacgtaaaaccttaaccgttacgtttagttaaggtttacgtttaaccgaaacgacggaccggacccgaacggtaccctaacgttaccgtaaccggaaccgggtacctaacctttaacgttttacgttccggttaacgggtttttaacccggtaaacccgggtaccgttccggggtacccggggtaccccggtaagtacgtacgttacacggggcccggtagtaagggttcggacgaacgtctacgttagttacttaacgactaacgttaagaaacttcggaaggtcgggaggggtcggacggtgtaagggtaggttacggtttagggttttacgggttacttcgtaacgctaggttaacggaagtaaccgttacgtaagttaccgggttccggtaccctttaacccgttacgggttcgtttaccggggaccggttaacggggaaacccttagggaccgttagggacctaaagtaaccccgtagggtaccgttcggtacgccgtacgacccttcgtcggttac

SEQ ID NO: 213401 - DNA, 1021 bp, Homo sapiens
  misc_feature: GYAE6OF01AGE5A.36.5.A05.1.454.CMB.1.raw
tcagtacgctgtctcacgaccggtgctcgatttagatagatagacaggggtgatcaggactcctcagttcaccttctcacaatgaggctccctgctcagctccgtgggctgctaatgctctggtcccagtatcaagcgagggattgttgtgatgactctagtcctccacgttcctccccgtcgtcccccgtccgtacccgttacggaccaccggcccggaccccttcccgtaccttcccttcccgtggtaccgtacgggttaccttaccggtaccctaaccgtacccgttaccccgttttacccgtttttaccggtacggttaggtaacggttaacgggtaaaaaccccttaccccgtttaacggtttaagtttaaacgttttccggttttaaccaaaccggtaggaacccgggtaccgaaccggtaaccctaaaccgttacccggtaaccgaaccggtacccggttacccttttaaagttttaaccgtaccggttttaaccgggttttaaccccggtaaccccgggggttaacctttcccggggttaccccgggggttaacccggaacccgtaaggttacccgttaccggaccgggtccgggtaccggtaaggggtttcggaccgtacggtacctaacgttacgtttaacttaccgaacctaacgttaacgtaaaacgtcggaacgggtacgggtaagggggtcggtaacggttacgggtacgggtaagggtttaagggttttacgggttttaaggggttttaactacggttacggtaactaacggttacggtaacgttaaacggttaacccgtacgtttaacccggtacccggttaccccggtttacccggtttaactttacccgggttttacggaacccggggttaaccgggtaaccggttacggtaaccggttaccggggaaactttaaaccccgggtaacccggtaaaccggttacccgttacggggtaccggttaccctacggtaaacccctccgttaccgtttcggtttacccc

SEQ ID NO: 213402 - DNA, 810 bp, Homo sapiens
  misc_feature: GYAE6OF01CURQW.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctcgtgggtcccagtatcaagcgagggatgttgtgatgactcacgtctcctacgtcctccctcgcccgtcctacccgttggaccacggcccgcctccactcctcctgacgtacggtactacgtcactacgtccctttcctttcagtagtacgtaacggtaaacctacttaacttagttaactttacggtttaaccaaacgtacggacggtacccgtaacgggtaaccctaacgttcccgaaccgtaaccggtaccgtaccttttaaattttacgtaccggtttaacgggttttaacccgtaaccgggtaccgtaccgggtacccggggtaaccggaacgtacggtacttacggacggcggtacggtaagggttcgggaacgtaacggtccgtaaacgtttcggttaactttaacccgaacttaacgttaaaacggtaaaacgtccggtaacgggtacgggtaaacgggggtacggtaacgggtacgtaagggtacggttaggtttaggggttttacgggtttataccgttaggactagtacgtaacggtaagtaaccgtacttaccggtccgtaccgttacgttaaccgttacggtttccgggaaccgtaacggggacctagggtactaacgggtactaacgtaccgtaaaccgtagtcgggtaccgtacgtacgtaacctgtacggttacc

SEQ ID NO: 213403 - DNA, 894 bp, Homo sapiens
  misc_feature: GYAE6OF01CUVLF.36.5.A05.1.454.CMB.1.raw
tcagtacgctgtctcacgaccggtgctcgatttagatagatagacaggggctgatcaggactcctcagttcaccttctcacaatgagctccctgctcagctccgtggggctgctaatgctcgtcgggtacccagtatacaagcgagggattgttgtgactgtactcgacgtcctccacgttcctccctcggtccccgtacctaccgtcggaccaccggtcccggccctcctactccttcccgtaggaccgtacgggtccttaactccgaccgaccgttcccttttaccgttttacgaaggttgtaacgaacggtaaacccttacctttaagttacggtttaaacgtttccggttttaaccgaaaacggaacggaccgggaaccccgtaacgggtaccccttaaaacgtccctaaacccggtaaaccggggtccctttaaacctttaacgttttacttaccggtttaaccggttttaacccgggtaaacccgggtcgttacccgggggttaccggggtacccaaaccgttacggacgtttaccggaccgggtccggaggttacgggttacccggggtaggtacccgtacgttaaccgttagttacctttaccgaaacgttacgtaaagtaacctcggaacgggtcgggtaaggggacggtagggttagagggttaacgggttagggtttacggggtttttaacggtttacgacgttacggtaccgaagtttacgggaaacctagggttaacctacggtaacgttccccggttaacccggttaaccgttacgttaccgttaacggggccgtaaccggggacacgggttacgacggttaactaacgtacccggaagtacgggttccgtggtaccttaccgacgtccttggttaaccc

SEQ ID NO: 213404 - DNA, 906 bp, Homo sapiens
  misc_feature: GYAE6OF01BS8FN.36.5.A05.1.454.CMB.1.raw
tcagtacgctgtctcacgaccggtgctcgatttagatagatagacaggggtcagagaggagccttagccctggactccaaggccttttccacgttggtgatcagcactgagcacagaggactcaccagtggaagttggggctgagtcgttgggtttttccttgtttgtttagttttaggaacggtcgacccgagtgtgaggttgcgtaggttgggtaggacgttcggtagggggagtcgttcggtccgacgggtcccggggggtccctagacgtacttccgtccgtcggccgtcgtacgtccgttcgtaggttaactttcggttaagggttttaacgttaacgttagtttagggagttaggtacgggtttccgggtcccgtaccgttgggtaccccttaccgggaaggggtttaaccgggggtcccgttagggggtacgggttacgggggtccgaacccgtaaacgttaccggtaacggacgggtaccgggtaaggttaggggaaacgtaacgaaaccggaaacttacggttagtcgggttacggacgtttcggttaggtaacgggacggtacccgtacgttaaccgaaccgttacttcccgtaaccggaacgaaccggtaacccgaaccgtaccaaacggttaacccttacgtttacggtttacgtttaaccgtaacgaacgttgaacccgtaccgtaccgtcggacgacgggtaccggaccgggtaggttaccggttcgttacccttcgttttacgttaacgttcgtgggttaccgagggttaggaaacgggtttccgggttaacccgttttagggtttcggaccgtttccgtttacccgtttcccggtttacccttttcgggttacggtttaccgggttccggggaaccccggttaacccggg

SEQ ID NO: 213405 - DNA, 802 bp, Homo sapiens
  misc_feature: GYAE6OF01DJ5VL.36.5.A05.1.454.CMB.1.raw
  modified_base (332)..(332): a, c, t, g, unknown or other
  misc_feature (332)..(332): n is a, c, g, or t
tcagtacgctgtctcacgaccggtgctcgatttagatagatagacaggggcgtgatcgaggactcctcagttcaccttctcacaatgaggctccctgctcagctcctgggctgctaatgctctcgggtacccagtactcgaagcgagggatgttgtgatgactcagtcctctagtcctcctgcccgtcacctggacacgcccgtcctccactcctccgtgacgtacggttactacgtccgtacgtacggtccttaccctttttcgaagttagtactacggtaaaacctaacccttaacgttacgttaaacgtttacgggtttaacccaaaanacggtaacggaccgttaacgggaacctaactacgtacccgtaacggtacccgtaaccttaacgttttaacgtaccgtaacggttttaccgttaaaacccggggtccgttaccggtaccggggttacccgggaacctaggttaacgttacccggtaaggcccgggtacggtttaacgggttaccggggtaacgaccggtaccggtaacttcggtaaacttttccgaaacgttacccgttaaggtaaaaacttccggaaaggttaccggaaagggggttcggtaaccgggtaacgttaagggtaccggttagttacgggtttacggggttttactacgttaggtactagtacggtaacgaacggttatacgtacgtcgtacccttcgttacgtacgtttgggacctacgggacacgtcgaggacgacgtaacgttaacgacgttagaccgtacgacctacgtctgttacccg

SEQ ID NO: 213406 - DNA, 901 bp, Homo sapiens
  misc_feature: GYAE6OF01DV660.36.5.A05.1.454.CMB.1.raw
  modified_base (320)..(320): a, c, t, g, unknown or other
  misc_feature (320)..(320): n is a, c, g, or t
tcagtacgctgtctcacgaccggtgctcgatttagatagatagacgaggggtgatcaggactcctcagttcaccttctcacaatgaggcctccctgctcagctccgtggggctgctaatgctcgtcgggtcccagtatcaagcgagggattgttgtgatacgtactactacgtcctacctacgttcctccccgttccgtacccgttcccgtaacccgttacgggaaccgtccggccccggtcccttaccctacttcccgttccgtcggtccgtacggttaccttacgtaccaacctaccgttccctttaccgttttacgngtagtaacgtaaccggaaaccttaccttaacgttacggttacgtttacggttaccaaacgacggacggacctaccggtactaacctccgtaccggaacggtaccgtaacgtttaactttgttaccggttacggttttaacccggtaaccggtaccggttaccgggtaccggggtcccgtaaggtacgttacgttacgacgggtacgtacggtagggtacggtacgacggtaccgttacgtgtttaaccctttaacgtacctaacgttaaacgtaacgtccggtaacggtaacgggtacggggtagggtaggtacgggtaagggtttacggggttagggtttttacgggttttaacggggttttaacttaacgttcgggtaacgtcggttaacggtaaccggttaaacggtaaccgttagttcccggttaccggttacccgttacccggttacttaaccgggttaccggaaccgggttaccgggtaacgtaccggtagggttacgtaaacggacccgttaaccggtaacggtacggttcgggaccgttacgacccggacttaccgtacgtttccgttaaccg

SEQ ID NO: 213407 - DNA, 747 bp, Homo sapiens
  misc_feature: GYAE6OF01E06EE.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagttctccacgtcctccctcgcccgtctacccgttcggaccacggcccggcctccatcctccgtgctacggtctagtcacacgtccttcctttacagtagataggaacctaccttacttgtaagtttcggttaccaacgtaggtacggaccgtacggacctaactaccgtaccgaaccgggtcctacccgtttaaagttttactaccggttaacggttttacccggtaaccgggtacttccgggtcgggtaccccggtactacggtacttcgacggccggtcgtacgggtcgggtacgagtaccgtagttacgtacttaccgaactaactaacgtaaacgtccgaaggtcggtaaggggtaggacggcgtaggtaagggtagtttcgggtttaggttttaacgtcggttagacttacggagtaacgtaacggtactaacgttacgtaccggttaccgttacccgttaagttaccgggtttaccggaacggtaaccggggaccgtaaacggtaccggtacggtaacaaccggttaccggaaacggtacgtacgggttccggtaccgtaccggcctacgtacgtttacccg

SEQ ID NO: 213408 - DNA, 807 bp, Homo sapiens
  misc_feature: GYAE6OF01ANOTM.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacacgccggcctccatcctcctgcagtctagtcactacgtccttcctttcagtcgagtaggaaacctaccttacttagtaagtttggttaccaaacgagacggtccgacggaccctaaatccgtaccgaacggtcctacccgtttaaattttacgtaccgtaacgggttttacccgtaaacccggggtaccttaccggtccggggggtaccccgaacgtacggtaactttcgaacggtacgggaccgtacgggttcgggtaccgtacgggtaccgtacgtacggttaactttaccgaaaccttaaccgttaagtaaaaacgtccgtaaacggggaccgggttagggggggttaacgggggtacggttaacggggaagggtttacgggtttaaggggtttttacgggggttttaacgtttaaccggttagggaccgttacggtacgggttaacgtaaacggggttaactagtacccgggttacggtaccccgttaccggttaccggttaccgttttaccgggacccggtaacgggtaccgaacggtaccggttaaggaacgtacgtacccgtaaaggccgttaggtcggtactacgcctactacttcgttcgttaacccg

SEQ ID NO: 213409 - DNA, 633 bp, Homo sapiens
  misc_feature: GYAE6OF01BBGL8.36.5.A05.1.454.CMB.1.raw
  modified_base (402)..(402): a, c, t, g, unknown or other
  misc_feature (402)..(402): n is a, c, g, or t
tcagtacgctgtctcacgaccggtgctcgatttagatagatagacagggggtgatcaggactcctcagttcaccttctcacaatgaggctccctgctcagctcctggggctgctaatgctctgggtcccagtatcaagcagggatgttgtgatgactcagtctccagtcctccctcgcccgtcacccttgacacgccgcctccattcctctgctacggtctacgtaccacacgtccctttctttacagtagatacggaaactaccttacgttacgtaagtttcgttactaacgagtacggccaggccaatcctaccgaaggccgtacttaagtttactcgtacggtttaccgtaaccgggaccgttgtaccggggtacccggacgagtacgtcacggcgagnggtggtcgaggctagtcgtatttcactacgtaacgtaacacgagacggtaggcggtagcgtgagggtgttagtttagggtttactgtgtatgtacgagtaagtcatcgtacgtccgtacgttaccgtgttaccggacggtaccggacacggttacggacggtagaccggttaacccgaaacggtcggttacggtcgtaaccggtgacccgtaacccttgtccggtttaccc

SEQ ID NO: 213410 - DNA, 547 bp, Homo sapiens
  misc_feature: GYAE6OF02G4K7K.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgaattggtttcaacagaggccaggccaatctccaaggcgcctaatttatcaggtttcaaccgggactcgtgggggtcccgacagattcagcggcagtgggtcaggcacgtgatttcacactagaaatcagcgagggtggaggcgtggaggtatggtttaggggtttaattacgtgcagttgcgaaaggtacagtacgtggtccctaccgttactacgttttcggaccgtaggggaccaggtcgtgggaatacgtaccgaaacgtacgttgtacggctgaccacctatcgttcg

SEQ ID NO: 213411 - DNA, 654 bp, Homo sapiens
  misc_feature: GYAE6OF02IYTN7.36.5.A05.1.454.CMB.1.raw
  modified_base (202)..(202): a, c, t, g, unknown or other
  misc_feature (202)..(202): n is a, c, g, or t
tcagtacgctgtctcacgaccggtgctcgatttagatagatagacaggggtgatcaggactcctcagttcaccttctcacaatgaggctccctgctcagctcctgggctgctaatgctctgggtcccagtatcaagcagggatgttgtgatgactcagtctccagtctccctgcccgtcacccttggacagccgcctccatnctctcgcgtagtctacgtcacacgtccttccttcagtacgtagtacgaactactacttagtaacgttgttacaacagacgacgacgactaactcctacgaacgtacgtaccttaacttactacgtacgttacgtaaccggtaccgtacggtacgggtaccggtacgtacgtacgtacgacgcggacgtacggtcggtacgtacggtacgtacgtacgtacgttactaacgtacgtaacgtaaacgtacgaacgacgtagggtaggacggtacgtaggtaggtagttaggttaggtttagttacgtacgtacgtagtacgtacgtaacgtaacgtacgtacgtacgtaccgttaccgtaccgttacgttacgtacgtacggtacgtacgtacgtacggtaacgtacgtaaccgtaacgtaacgtacgtacggtacgtacgtacgtactactcg

SEQ ID NO: 213412 - DNA, 532 bp, Homo sapiens
  misc_feature: GYAE6OF02FRLII.36.5.A05.1.454.CMB.1.raw
tcagtacgctgtctcacgaccggtgctcgatttagatagatagacaggggtgatcaggactcctcagttcaccttctcacaatgaggctcccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgaattggtttcaacagaggccaggccaatctccaaggcgcctaatttatccaggtttctaaccgggactcgtggggtcccgacagattcagcggcagtgggtcaggcactgatttcacactgaaatcagcgagggtggaggctggaggatggttgggtttatacgttgcagtgcaaggtacagtactggccttccgtactacgttttcggcctacggggacctagcgtacgggagacgtcccgaaacggtactggtcggctacgccaccatcttacg

SEQ ID NO: 213413 - DNA, 547 bp, Homo sapiens
  misc_feature: GYAE6OF02FORKQ.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatcctcctgcaggtctagtcacagcctcctttcagtgatggaaacactacttgaatttggtttcaacagaggccaggccaatctccaaggcgcctaatttatcaggtttctaaccgggactcgtggggtcccggacagattcaggcggcaggtgggtcaggcacgtgatttcactactagaaatcagcgagggtggaggctggaggtagtggtttaggggtttattacgtgtctagtgacgaaggtactattacgtcggtaccttccgttactacgttttcggaccgtaggggacctaggctgggaagtactaccgaacgaactggtacggctcgctaccatctcg

SEQ ID NO: 213414 - DNA, 580 bp, Homo sapiens
  misc_feature: GYAE6OF02IR667.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacacgcctccttttcagtgatggaaacacctacttgaattggtttcaacagaggccaggccaatcctccaaggcgacctaatttatctaggtttctaaccgggactcgtcggggtcccgacagattcagcggcagtgggtcaggcactgatttcacactagaaaatcgaagcgagggtggaggcgtaggagggtattgggtttaggggtttatttacgtgtacgtagtgacgtaaggtaactaagttacgtacggtccctaccgttaaccttacgtttcggaccgaacggggtaccaggcgtagggacgtaactaccgaaacgtaccgtaggtcggcgtcgaccgacctattccgttacg

SEQ ID NO: 213415 - DNA, 524 bp, Homo sapiens
  misc_feature: GYAE6OF02G32OS.36.5.A05.1.454.CMB.1.raw
  modified_base (517)..(524): a, c, t, g, unknown or other
  misc_feature (517)..(524): n is a, c, g, or t
tcagtacgctgtctcacgaccggtgctcgatttagatagatagacagggtgtacacctgtggttctcgggctgccctttggttttggagatggttttcgtcgatgggggctggagtgggtggccaacataaaggaagatggaagtgaggactactatttggactctgtgaggggccgattcaccgtctccagagacaacgccagaaactcagtgtctctgcaaatgaaccagccttgagagtacgaggacacggctgtgtattactgtgtcgaccctaggatagttgcgaatgggggttactgctccgcgggggtcgctggtagatgccttttgacatcctggggccaaggggacgatggtcaccgtctcttcgagcctcaccaagggcccatcggtcttccccgtggccgccctgcctccaggacgccacctccgagacgcacaggccggccctgggctgcctggtcaaggctacttccagacagcgtactgagcgggctgggcaaggcgcatagnnnnnnnn

SEQ ID NO: 213416 - DNA, 521 bp, Homo sapiens
  misc_feature: GYAE6OF02GDCPR.36.5.A05.1.454.CMB.1.raw
  modified_base (514)..(521): a, c, t, g, unknown or other
  misc_feature (514)..(521): n is a, c, g, or t
tcagtacgctgtctcacgaccggtgctcgatttagatagatagacagggtgtacacctgtggttctcggggctgccctttggttttggagatggttttctcgatggggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgcgaccctaggatattgcaatgggggttactgctccgcgggggcgctggtagatgcttttgacatctggggccaaggggacgatggtcaccgtctcttcagcctccaccaagggcccatccggtccttcccccgtggccgccctgcctccgaggacgcacctccgagacgccacgagccggccctgggcctgcctggtcaaggctacttccagacagcgtactgagcggctggcaaggcgacagtagnnnnnnnn

SEQ ID NO: 213417 - DNA, 604 bp, Homo sapiens
  misc_feature: GYAE6OF02I73W0.36.5.A05.1.454.CMB.1.raw
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgtaattggtttcaacagaggccaggccaatctaccaaggcgcctaatttatcaggtttcaaccgggatcgtggggtcccganagnttcagcggcaggtgggtcaggcactgactttcacactagaaatcagcgaggggtggaggcgtggtaggagttgggttggggttttaagttacgttggctaattggacgtaaggttacattacggtcggtcccgtccgttaaccgttacgttttcggaccgtaacgggggtaacccaggtacgttacggggacggtaacgttacccgtaaacggtaacgttcgggttacgggtacgtaccggaccgtaccctacgttccgtttacg

SEQ ID NO: 213418 - DNA, 655 bp, Homo sapiens
  misc_feature: GYAE6OF02IZCWN.36.5.A05.1.454.CMB.1.raw
  modified_base (358)..(358): a, c, t, g, unknown or other
  misc_feature (358)..(358): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacacgcccggcctaccatctcctgcgagtctagtcacagccttccttttcagttgatggaaacaccttactgtaattggttacaacagaggccaggccaatcctccaaggccgtacctaatttactcgtacggtttacctaaccgggtactcgttcggggtacccggtanacgtaattccgaggtcgcgtaggtcgggtacagggcacgtaggtactttaccacaacgttagaaacttcgagtcgtagggtaggaggcgtagagggtaagttgggtttagggtttattacgtagctaggttagacgtaaagggttaactacgtacgtcgggtacccttacgttaaccgttcgtttacggaccgaacgggggtacctaaggtccgtagggtaacgtaccgttaaccggaaaccgttaccggtaaggttcggaccgtacggtaacccgaccgttaccgttacttaccgg

SEQ ID NO: 213419 - DNA, 511 bp, Homo sapiens
  misc_feature: GYAE6OF02FZJ8V.36.5.A05.1.454.CMB.1.raw
  modified_base (504)..(511): a, c, t, g, unknown or other
  misc_feature (504)..(511): n is a, c, g, or t
tcagtacgctgtctcacgaccggtgctcgatttagatagatagacagggtgtacacctgtggttctcggggctgccctttggttttggagatggttttctcgatggggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgcgaccctaggatattgcaatgggggttactgctccgcgggggcgctggtagatgcttttgacatctggggccaaggggcgatggtcacgtctcttcagcctcaccaagggcccatccggtcttccccctggccgccctgcctccaggagcacctccgagagcacagcggcctgggctgcctggtcaaggcctacttccagacagcgtactgagccgggctggcaagggcgcagtagnnnnnnnn

SEQ ID NO: 213420 - DNA, 560 bp, Homo sapiens
  misc_feature: GYAE6OF02FX02N.36.5.A05.1.454.CMB.1.raw
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagccttccttttcagtgatggaaacacctacttgaatttggttacaacagagccaggccaatctccaaggcgcctaatttatcaggtttccaaccgggactcgtggggtcccganagattcagcggnaggtgggtcaggcagtgactttcacacgtagaaatcagcgagggtggaggcgtaggaggagttggttaggggtttattacgttgctagtgacgtaaggtactagttacgtcggtccttaccgtacttaccgttttcggaccgtacggggaccaggtcgtagggagtactaccgaacgtacgtaggtcggtactcgaccacctatcgttacg

SEQ ID NO: 213421 - DNA, 651 bp, Homo sapiens
  misc_feature: GYAE6OF02I1HBV.36.5.A05.1.454.CMB.1.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
tcagtacgctgtctcacgaccggtgctcgatttagatagatagacaggggtgatcaggactcctacagttcaccttctcacaatgaggctccctgctcagctcctgggctgctaatgctctgggtcccagtatcaagcagggatgtgtgatgactcagtctccagtctccctgcccgtcacccttcggacacgccggcctccatctcctgcagtctagtcacacgcctcctttcagtgatggaaacncctacttgaattgttacaacgngaggccaggaccaatcctaccgaaggccgaccttaattttacncctaacggttttccaaaccggggtacttcgtacgggggtcccgacagtagtttccgaggcggacaggttcgggcacggcactggtactttaccgactacgtagaaattccgaagtacgagggtaggtaggcgtaggtaggtagttggtttaggggtttaattacgtggtactagtgacgtaacggtactacgttaacgtggacccttaccggtaacttaccgttttacggacccgtaacggggtaacccagggtaccgttagggaacggtaccgttacccgaaaccgtaacgttcggtacggtacgtacgtacccgtaacccgttagtacctttaccgg

SEQ ID NO: 213422 - DNA, 594 bp, Homo sapiens
  misc_feature: GYAE6OF02GBCTN.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacacgccttccttttcagtgataggaaacaccttacttgaatttggttacaacagacggccaggaccaatcctaccaacggtcgacccttaatttactacgtaggtttaccgtaacccgggtacttcggtcggggtacccgacagtacttcgaggcggcaggttcgggtcagggccacgtgatttacgactaacgtagaaactcgagacgagggtggagcgtaggaggtagttggtttaggggtttattagtgtactagtagacgtaagtacagttacgtacggtcctacgttactcgtttacggcgtagggacagtcgtagggataacgtaccgaacgtactggtacgacgttacgacaccgtatccgttacg

SEQ ID NO: 213423 - DNA, 597 bp, Homo sapiens
  misc_feature: GYAE6OF02H40FD.36.5.A05.1.454.CMB.1.raw
  modified_base (304)..(304): a, c, t, g, unknown or other
  misc_feature (304)..(304): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcaccccttggacagcccggcctccatctcctgcaggtctagtcacagcctcttttcagtgatggaaacacctactgaattggttcaactagaggccaggccaatctccaaggcgacctaatttanctaggtttctaaccgggactcgtcggggtcccggacagattcagcggcaggtgggtcaggcacgtgtactttcactaactagaaaatcagcgaggggtcggaggcgtaggaggtagttgggtttacggggtttatttacgtgctagtgacgtaaggtactaagttacgtacggtcccttccgttaacgttccgttttaggaccgtaacggggtaaccctaggtaccgtagggaacgtactaccgaaacgtaacgtcggttacggcgtacgacccaaccgtacgttccttacgg

SEQ ID NO: 213424 - DNA, 594 bp, Homo sapiens
  misc_feature: GYAE6OF02HM0TH.36.5.A05.1.454.CMB.1.raw
  modified_base (268)..(268): a, c, t, g, unknown or other
  misc_feature (268)..(268): n is a, c, g, or t
  modified_base (345)..(345): a, c, t, g, unknown or other
  misc_feature (345)..(345): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagccttccttttcagtgatggaaacacctacttgaattggttcaanagaggccaggccaatctaccaaggcgaccttaatttactctaaggttttccaaaccgggctcgtgggggtcccgganagtattcgagcggcaggtgggtcaggcacgtgactttcactactagaaatcgagcgagggtggaggtcgtaggaggtagttgggtttaggggtttattaccgtgacgtagtagcgtaaggtactagtacgtcggtcccgttaccgtacttaccgttttcggacccgtaaggggaccctaaggcgttagggacgtactaacccgaaccggtaacgtggtacggaccgtgtacccacgtacgttcttaccg

SEQ ID NO: 213425 - DNA, 755 bp, Homo sapiens
  misc_feature: GYAE6OF02H35I5.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtccacagtccttccttttcagtgataggaactaccttacttgtaattggtttacaacgtaggacggccaacgggaccaacttcctaccgaaagggccgtaccctttaaattttaacgtccgttaacggggtttttaccgttaaaccccgggggtacctttccggttaccggggggtacccccgggtaactaacggtacgtttaccgacgggtccgggacgtagggtttcggggtacgaacgggcctaacgttacggttaacttttaccaaccgtaaccgttaagaaaacttccgtaggacggtaaggggtgggtaacgggcttagggaagggtagtttagggtttttaggggtttactttaacgtggtactaagtcggaacggtaaagggttacctaagttaccgttcggtaccccgtttaccgttaccgtttacggttttacgggaacccggtaggggtaaccctaagggtccgtagggaacgtaccgtaaccgaacgtacgtggtacgaccgtcgacctaccgtacttcgttacg

SEQ ID NO: 213426 - DNA, 787 bp, Homo sapiens
  misc_feature: GYAE6OF02HVCBX.36.5.A05.1.454.CMB.1.raw
  modified_base (579)..(579): a, c, t, g, unknown or other
  misc_feature (579)..(579): n is a, c, g, or t
tcagtacgctgtctcacgaccggtgctcgatttagatagatagacggaggggtcagaggaggacgtccttacgcccgtggacctaccgaacggtccctttccctacgtttgggtgatcagccactgagcacaggaggactcaccagtaggtaagttggggctgagtcgtttcgggtttttcctttggtttgttttagttttaaggaaggtcgcccgtaggttggtaggtagggtgcgtaggtttgggtgggtagttcgggtggggggaggtcgttcggtccgacggggtcccggggggtcctggacgctctcgtcgcgcacgcgtcgtggtattcggttaggtttaggtcggtacttaggttggtatggtaggttcggtccgtcccggccgacggtccgtcggggggacggggggggggtcgtggggagggtggggtcggaccgaaacgtaaggtaaaaggaagtaggtagggtaaggtaggaaggtacgtacgttaagtttggacttcgttggtagggacggggacgtacgttccgtaccgtcctaccgagtacgaacgtaaccgacaaacgtaaccncgtagtcgtactcgtagaactaagtacgaacagtcctagagacggtacggacggaccgtacggcgttagtagtttacgttacggttgtaccggacccgtaacccggttaggtaactttacgttacggacgtttaaggggtttcgggggtttactaccggtccggttacccggggggcggggccggttacggttggggtaagttacggg

SEQ ID NO: 213427 - DNA, 604 bp, Homo sapiens
  misc_feature: GYAE6OF02I5PU1.36.5.A05.1.454.CMB.1.raw
  modified_base (593)..(593): a, c, t, g, unknown or other
  misc_feature (593)..(593): n is a, c, g, or t
  modified_base (597)..(598): a, c, t, g, unknown or other
  misc_feature (597)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
tcagtacgctgtctcacgaccggtgctcgatttagatagatagacagggtgtacacctgtggttctcggggctgccctttggttttggagatggttttctcgagtggggggctggagtgggtggccaacataaaggaagatggaagtgaggactactatttggactctgtgaggggccgattcaccgtctccagagacaacgccagaaactcagtgtctctgcaaaatgaacagcctgagagtcgaggacacggctgtgtattactgtgcgaccctaggattattgcaagtggggttactgcgtccggcgggggcgcgtggtagagtgtcttttgactatcggtggggaccaagggcgagtggtcaccgtctctcacgcctccaccgacggcctacgtccgtccttccccgtgcctcccgtcgcctccgacggacgccaccgtccgagacgcaccgacgcccggtcccgtgggcctcggccgtcggtaccgaacggtaccttaccgttaccgacgtaccgacggtaccgttaccgtaggaccgggccgggtaccggtacgggacggaaccggccggaacgtaacggttacggncgcnncngngc

SEQ ID NO: 213428 - DNA, 785 bp, Homo sapiens
  misc_feature: GYAE6OF02IZSF7.36.5.A05.1.454.CMB.1.raw
tcagtacgctgtctcacgaccggtgctcgatttagatagatagacaggggtgatcaggactcctcagttcaccttctcacaatgaggctccctgctcagctcctgggctgctaatgctcgtgggtcccagtatcaagcagggatgttgtgatgactcagtctccagtctccctcgcccgtcaccttggacacgccggcctccatcctcctgactaggtctagtccacacgtccttcctttcagtgactacggaaacctacctacttagtaacgtttcggttacaaacgtggaacggccgtacggaccctaaagtccgtacccgtaaaggccgtaaccttttaaattactcgttaaaccggtttcgtaaaacccgggtcctccggtttacgggggaccccggtactaacggtacttacggacggccgggaacgtcgggttacgggtccgaacgtccaacgttacgtacgtttaccaaccgtacgttaaacggtaaactacgaagggtccgtaagggggtacgggacgggtacgtaggggtaacggtagtttacggggtttagggtttaacgtttaacggtcgacgtaagttacggaacggttaaacgttaaccgtaacggtaacgttaccgggtaccttacccggttacttaaccgggtttacgaacccgggtacgggggtaacctacgggtacgtacgggtaacggttaaccctaccggtaaaaccggtacgtttacggtacggtaccggttaaccggccctaaaccggttctaccggtttaccg

SEQ ID NO: 213429 - DNA, 553 bp, Homo sapiens
  misc_feature: GYAE6OF02FZR8J.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcaggatgttgtgatgactcagtctccagtctccctgcccgtcacccttggacagccggcctccatctcctgcaggtctagtcacagcctccttttcagtgatggaaacacctacttgaattggtttcaacagacggccaggaccaatctccaaggcgcctaatttatctaggtttctaaccgggtactcgtggggtcccgacagattcagcggcagtggtcaggcactgatttcacactagaaaatcagcgagggtggaggctggaggattggttggggtttattacgtgctatgtacgaaggtaacatacgtcggtccttccgtactacgttttacggaccgtacggggactaacggcgtaggtaacgacgtaccgtaacgaacctggtacggcttacggaccacctattaccg

SEQ ID NO: 213430 - DNA, 584 bp, Homo sapiens
  misc_feature: GYAE6OF02F39PP.36.5.A05.1.454.CMB.1.raw
  modified_base (354)..(354): a, c, t, g, unknown or other
  misc_feature (354)..(354): n is a, c, g, or t
  modified_base (577)..(577): a, c, t, g, unknown or other
  misc_feature (577)..(577): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctacgtcacacgtcctccttttcagtgatggaaaccactacttgaatttggttcaacagaggccaggccaatcctaccaaggcgaccttaaatttactcgtaaggttttacctaaccgggtactcgtcgggggtcccganagacttcagcggcaggtggtcaggcacgtgatttcactactagaaatcagcgagggtaggaggtctggaggtagtggtttaggggtttattacgtgacagttgagtaagtaacacgttacgtaggtcccttacggtactacgttttcggacgtacgggtaccgaggtcgtagggtactaacgtaccgaaacgtacgtggtacggtcgtacgacctacgtactnttaccgg

SEQ ID NO: 213431 - DNA, 759 bp, Homo sapiens
  misc_feature: GYAE6OF02JD6WX.36.5.A05.1.454.CMB.1.raw
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
tcagtacgctgtctcacgaccggtgctcgatttagatagatagacaggggtgatcaggactcctcagttcaccttctcacaatgaggctccctgctcagctcctgggctgctaatgctctgggtcccagtatcaagcagggatgttgtgatgactcagtctccagtctccctgcccgtcacccttggacagccggcctccatctccngcaggtctacgtcacncgtccttcctttcagtgaatggaaacacctacttgtaattggttacaacagacgccaaggccaaatcctacccgaaaggccgtaacttaatttacgtaccgtagggttttaccgtaaacccggggtacttcggttacgggggtacccggacaagtacttccgaaggcggactaagggttcgggtaccgaacggtctaacgtcgtaacgtttcgaacccagtaacgaaaacgttacgaacggacggtaaggggtacggaggtacgtagggtaacgggtaaggttagggttttaggggtttaactttaaccggttagtaccgttaggtacggtaacggtaaacgggttaactaacgttaaccggtacggtaccccgttaaccggtttaccttaaaccggttttcgggaaacccgttacgggggtaaacccgtacgggtacggttaacgggtaacggtaaaccgttacccggaaaaccgttaaccggtagggttacggacccgttaggaaccccgtaacggttacgttaccggtttccg

SEQ ID NO: 213432 - DNA, 611 bp, Homo sapiens
  misc_feature: GYAE6OF02FG7FC.36.5.A05.1.454.CMB.1.raw
  modified_base (295)..(295): a, c, t, g, unknown or other
  misc_feature (295)..(295): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatcctcctgcaggtctagtcacagccttccttttcagtgatggaaaccacctacttgaatttggttcaacagaggccaggccaatctccaggcncctaattatcaggtttctaaccgggtctcgtcggggtcccgacagtattcaggcggctaggtcgggtacagggcacgttgtactttccaacactagaaaatcaagtcgaggggtggaggctagggaggtagtggttttaggggtttaattacgtgacgtagttacggacgtaaagggttacattacgtcgggtcccttaccgttacttaccgttttgggacccgtaacggggtaccagggtcgtagggaacggtaactacccggtaaaccgtacgttggtacgggccttacggaccctaccgtacgttcgttacgg

SEQ ID NO: 213433 - DNA, 656 bp, Homo sapiens
  misc_feature: GYAE6OF02H1IML.36.5.A05.1.454.CMB.1.raw
  modified_base (420)..(420): a, c, t, g, unknown or other
  misc_feature (420)..(420): n is a, c, g, or t
tcagtacgctgtctcacgaccggtgctcgatttagatagatagacaggggctgatcaggactcctcagttcaccttctcacaatgaggctccctgctcagctcctggggctgctaatgctctgggtcccagtatcaagcagggatgttgtgatgactcagtctccagtctccctgcccgtcacccttggacacgccggcctccatctcctgcaggtctagtcacacgtccttcctttcagttgatacggaaaacctaccttacttagaatttcgggtttaccaaacgtaggacgggtacccaacggccctaaactcctaccggaaacgggccgtaaccttaattttactacgtaggttttaccgtaaccgggtactcggtccggggtaccgactacgtatcgagcggcgtaggtggtacnggctacgtgtattcactatagaaactgacgagagggtggaggacgtggaggtagttggtttagggttttattacgttgactagtagtacgtaaagtacgtaacgttacgttacggtcccgttaccgttaccgttacggttttacggaccggttaaccgggacctaacggcgtacggaagtaccgaaccgtaacggtacgttcgggtacgtaccgtacggtcctaccgtagttaccg

SEQ ID NO: 213434 - DNA, 988 bp, Homo sapiens
  misc_feature: GYAE6OF02HJJE2.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacacgccttaccttttcagtcgaattcggaaaacctacccttacgttagtaaactttcgggtttaccaaacgtaacggacgggcccctaaagggaccctaaaacttccgttaacccgaaaacggggtcccgtaacccgttaaaattttttaaccgttccgtaaaccggggttttttaccgtaaaaaccccggggggtacctttacccgggttaccggggggggtttaccccccgggaaaccgttaacggtaaccgtttaccgaaacggggtccgggtaccgtaagggttcgggggtttacccgaaggggtccctaaacgtttggtaacctttttaccgaaaccgtaccgtttaaggtaaaaacgttaccgtaacgggtaccggtaaacgggggttacgggtaacggggtaccgttaacggggtaacgggttaagggttttacggggttttaaggggggttttttaacgttttaacccgggttacggttaaccggttaacgttacgggtaaccgggttaaaacgggtttaaaccgtaaacggtttaacccgttaccggggttaccccgtttacccgggttaaacccgtttaaccggttttttaccgggacccgggtaaccgggggttaacccgtaaccgggttaccggttacggggtaaacgggtaacccgttaacccggtaaaacccgggtaaaccggtttacgggttacgggttacccgttaccgggtaaccccgtaacccggttaaccgttaccgttttaacccgg

SEQ ID NO: 213435 - DNA, 582 bp, Homo sapiens
  misc_feature: GYAE6OF02G4F0N.36.5.A05.1.454.CMB.1.raw
  modified_base (349)..(349): a, c, t, g, unknown or other
  misc_feature (349)..(349): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtccacccttggacagccggcctccatctcctgcaggtctagtcacacgccttcctttcagtgatggaaacacctacttgaatttggtttcaactagaggccaggaccaatctccaaggcgaccttaatttatctaggttttctaacccgggactcgtcggggtccccgganacgtattcagcggcaggtgggtcaggcactgtatttcactactagaaatcagcgagggtggaggctggaggtagttgggtttggggtttatttacgttgactagtgacgtaaggtactagtacgtcggcccttccgttaactacgttttcggaccgtacggggaccctagtccgtaggtaacggtactaccgaaacggtacgtggtcggcttcggacacccgtactcgttacg

SEQ ID NO: 213436 - DNA, 792 bp, Homo sapiens
  misc_feature: GYAE6OF02GB7P6.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctcctcgcccgtcacccttggacacgccggcctccactctcctgcaggtctagtcacacgtccttcctttcagtgatacggaaacctaccgttaacttagtaaatttggtttacaaacgtaggacggtaccacgggcctaaattcccgtaccgaacggccgtacctttaaattttacttacgttaacgggttttaccgtaaacccggggtaccgttccggttacggggggtaccccggtacgaacgtacgtttacgacggtccgggacgtagggttacgggacgtacgggacctacgttagtacttttaccgaacctaacgtaacgtaaaactccggaaggaccggtaagggggtacgggtacgggtacgtacggggtaaggggttaacggtttcggggtttttaagggggtttttaaacttacgtttaggccttaaggttacgggtaacgtaacgggtttaactaacggttacgtacccgggttcccgtttaccggtttacctttaaccggtttccgggaacccgggtacggggtaaccgtacggtacgtacgggtaacaccggttaaccaacggttaacgttcgggtacggtcgtaccggcctaaccggttactccggttacg

SEQ ID NO: 213437 - DNA, 869 bp, Homo sapiens
  misc_feature: GYAE6OF02HMBMU.36.5.A05.1.454.CMB.1.raw
  modified_base (275)..(275): a, c, t, g, unknown or other
  misc_feature (275)..(275): n is a, c, g, or t
  modified_base (359)..(359): a, c, t, g, unknown or other
  misc_feature (359)..(359): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagccttccttttcagtgatcggaaaccaccttacttgaatttggtttaccaanacggaggcccaaggaccaaactcctaccgaaagggccgtaccttaattttactccgtaacggttttaccgtaaaccccggggtnttccggttacggggggttacccccggaagtaacggtaacgtttccgaacgggccgggacgtaacggggttcggggtaccgacgggaccgtaacgttcggtaacgtttttaccgaaccctaacggtttaaaggtaaaattacccggtaagggtaaccggtaaggggggttagggaacggggtcgtacggggtaagggttaaggtttggggtttttacgggggttttaaacgttttaccggttaggttaccgtaagttacgggtaaccggtaaaacgggttaaccgtaacgtttaacccggttcggggttaccccctttacccgggtttaaacccgtttaaccggggttttttacccggggaacccgggtaaccggggggtaacccctaacggggtaccgtttacggggaaaccggtaaccgttaccccggtaaaaaccggttaaccggtttacgggtacgggttcccggtaacgggtaccctaacccggttaacgttcccggtttacccgg

SEQ ID NO: 213438 - DNA, 684 bp, Homo sapiens
  misc_feature: GYAE6OF02IEL1Z.36.5.A05.1.454.CMB.1.raw
tcagtacgctgtctcacgaccggtgctcgatttagatagatagacagggggtgatcaggactcctcagttcaccttctcacaatgaggctccctgctcagctcctggggctgctaatgctctgggtcccagtatcaagcagggatggttgtgatgactcagtctccagtcctccctgcccgtcacccttggacagccggcctccatctcctgcaggtctagtcacacgcccttccttttcagtgataggaaaccacctacttgtaattggtttcaacagaggccaggccaatcctaccgaacggccgaccttaattttactacgtacggttttaccgtaaacccggggtacttccggtcggggggtaccccggaacaggtactttaccgaggtaccggtacgaaggttcggggtacgagggtctaacgtggtaacttttccaactaaccgtagtaaaactcgaacggcgaaggggtgggaggtcgtagggaaggtacgttgggtttaggggttttaattacgtgtaccgattaggacgtaaggtactaagtaccgttcgggtacccttaccgttaccgttaaccgttttcgggaaccgtaacgggggaacctaacggtcggtaggagtaaccgtacccgaaacggtaacgttggtcggcgttaccggactaaccctgtcttacg

SEQ ID NO: 213439 - DNA, 831 bp, Homo sapiens
  misc_feature: GYAE6OF02GK9DW.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtcctccagtcctcccgtcgccccgtccacccgttggacacgcccggcctccatcctcctgcaggtctagtcacacgccttccttttcagtgatacggaaacacctacttagtaatttcggtttacaaacgagaacggccaacggcctaaatcctaccgaacggaccgtacccttaattttactcgtaggtttaccgtaaccggtacgttcggtccgggggtacccgaacgtacgtaacgttcgaaggccgggtacgtagggtacggggttacaacgggtcccgtaaccgttggtaacctttttaccggaaacctaaccgttaaacgtaaaaaacgttccgaaacggtaccggggaagggggtacggggtaaggggtaaccgttagggaaaccggggtagttttagggggttttaacgggggtttttaactttaaaccggggttgtaaccgttaaggttacgggtaaaccgttaaaacgggttaccgttaaacgtaacccggtttcgggttaaccccgtttaacccggtttaaccgtttaacccgggtttttcgggaacccgggtaaggggtaaccccgtaagggtccggtaacggaaggttaaacccgtacccgtaaacggtaaccgtacgggttcggtaccgtcggtaaccctaccgttacgtccttacgg

SEQ ID NO: 213440 - DNA, 573 bp, Homo sapiens
  misc_feature: GYAE6OF02JH7JB.36.5.A05.1.454.CMB.1.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (360)..(360): a, c, t, g, unknown or other
  misc_feature (360)..(360): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (535)..(535): a, c, t, g, unknown or other
  misc_feature (535)..(535): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (568)..(573): a, c, t, g, unknown or other
  misc_feature (568)..(573): n is a, c, g, or t
tcagtacgctgtctcacgaccggtgctcgatttagatagatagacagggtgtacacctgtggttctcgggctgccctttggttttggagatggtttctcgatgggggctggagtgggtggccaacataaaggaagatggaagtgaggactactatttggactctgtggaggggccgattcaccgtctccagagacaacgccaagaaactcactgtatctgcaaatggacggcctgagatcccgaggacaccggtntgtagtatttacgttgtgcgaggagatttagaactactaaagtttccgagtnactggtatgatgcttangataccgtggggccaagggcccatggtacacccgtntacttcagtccctcaccaacgggtccccaagtccggttaccttcccccgtggcccgcccgtgcctcgacggacgccgacctacccggngacncgaccgacgcccggaccctcgggctccgcgtcggtcaacggctaccgttccagaccgagccgtacgtagaccggcggtaccgngaccgaggtccgcgtaagtacggcngntgnacnnnnnn

SEQ ID NO: 213441 - DNA, 737 bp, Homo sapiens
  misc_feature: GYAE6OF02JD0VQ.36.5.A05.1.454.CMB.1.raw
tcagtacgctgtctcacgaccggtgctcgatttagatagatagacaggggctgatcaggactcctcagttcaccttctcacaatccgaggctccctgctcagctcctggggctgctaatgctctgggtcccagtatcaagcagggatgttgtgatgactcatcgtccagtcctccctcgcccgtcaaaccgttcggacacgccggcctccatctcctgcaggtctagtcacacgtccttcctttcagtgaattacggaaacctacctacttagtaatttcggtttacgaaactacggtacggacccaaggtacccaaactccgttaccgaaacggtccgtaaccctttaaatttaccgtcgttaaccgggtttaccgtaaacccgggtacgttccggtccgggggttaaccccgaacgaacggtacgttacgacggtaccggagttaacgggtcgggtacgacgggtactacggttacgtacgtttacaaacgtaccttaagaaaactcggtaacggtacggtaaggggtcggtaagtcggtaggtagggtacgttggtttacggggtttaacttacgcgtacgtagtcgtaacgtaacggtagtacgtacgtcggttaccgtccgttaagtaccgtttacggacgtaacgggaccgtaggtaccgtaggtaaccacgttaaccgaaccgttaacgtcgggttacgtaccgtacggtccctaacggttcttaccggg

SEQ ID NO: 213442 - DNA, 752 bp, Homo sapiens
  misc_feature: GYAE6OF02GBMBZ.36.5.A05.1.454.CMB.1.raw
tcagtacgctgtctcacgaccggtgctcgatttagatagatagacaggggtcagagaggagccttagccctggactccaaggcctttccacttggtgatcagcactgagcacagaggactcaccatggaattggggctgagctgggttttccttgttgttattttagaaggtgcccagtgtgaggtgcagttggtggagtcgtgggggaggcgttggtccaggcccggggggggtccctggacgactctccgtgcgcaggcgtctggattcgaggtttagtggcttagttggatgaggttggccgtccgccgaggccgtccgggagggggggggcgtgggaggtggggtggaccgaacgagtaaaaggagagtagggaagtgaggactacgtagtttggactcgtggtggacggggtccgtagttccgacccgttcgtcccgagacgaccaaaccgccgaagaaacctacgtagttcgtccttcgtacgactaaacgttagaaacctcgacccgtaggaacggtacggtacgggaacggtaaccggaccgggtacgttacggttacgtttaacgtttaccggttggttaccgggtacccggtaaccccggttagggtactttaacggttacgggtaacggtttaaacgggggtttcgggggtttaaccggttccgggttacccggggttacccccggggggttccggggggggtacccggttaccgggtttaccggggttaggttaaccggg

SEQ ID NO: 213443 - DNA, 861 bp, Homo sapiens
  misc_feature: GYAE6OF02JBTGT.36.5.A05.1.454.CMB.1.raw
  modified_base (229)..(229): a, c, t, g, unknown or other
  misc_feature (229)..(229): n is a, c, g, or t
tcagtacgctgtctcacgaccggtgctcgatttagatagatagacaggggtgatcaggactcctcagttcaccttctcacaatgaggctccctgctcagctccgtgggctgctaatgctcgtgggtcccagtatacaagcgagggattgttgtgatgacttcagtctccacgtccttccctcgcccgtccgtacccgttggacgaccgtcccggcctaccactctcccnggtaccgaggtctacgtacacgtacgttcccctttaccgtttaccgtagtagtaacgtacggtaaaacctacctttaacgttaggttaaagttttccggggtttaacaaacggtacggaacgggtcccgaacggaccctaacgtaccgttaccgaacgggtacctacctttaaatttacttaccgtacggtttaccggtaaccgggtaccgttccgggtaccgggggtaccgaacgtacggtaccttcggaacgggtcgacggtacggtgggtacggacggtacctacgttacgttaacgttaccgtaacgtacgtaaacgtaaaacgtacgtacggtaacgggtaacgggggtacggaaggtacggttagggaaacgggtttacgggtttacgggggtttttaagggtttaccggttttaaggtaccggttaacgttaaggtaccgggtaagttaacgtacgttaaccggttaccggttacgggtccctaaccgggtttaccgtttaaccgggtttacggacccgggtaaacggtaccggtagtacgggtaacggtacggtaacctaacgtaaaccgggttctacggttacgggacttaccgggtaacccacgggttcctacggtttaccg

SEQ ID NO: 213444 - DNA, 568 bp, Homo sapiens
  misc_feature: GYAE6OF02GICU9.36.5.A05.1.454.CMB.1.raw
  modified_base (257)..(257): a, c, t, g, unknown or other
  misc_feature (257)..(257): n is a, c, g, or t
  modified_base (449)..(449): a, c, t, g, unknown or other
  misc_feature (449)..(449): n is a, c, g, or t
  modified_base (550)..(550): a, c, t, g, unknown or other
  misc_feature (550)..(550): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(568): a, c, t, g, unknown or other
  misc_feature (564)..(568): n is a, c, g, or t
tcagtacgctgtctcacgaccggtgctcgatttagatagatagacagggtgtacacctgtggttctcggggctgccctttggttttggagatggtttttctcgagtggggggctggagtggggtggccaacataaaggaagatggaagtgaggactactatttggactctgtgaggggccgattcaccgtctccagagacaacgccagaaactcagtgtctctgacaaatgaacagcctgagagtcgaggacacggntgtgtattactgtgcgacctaggatattgacaagtggggttactgtcgtccggcgggggcgcgtggtagagtgtcgttttgactagtcgtggggaccaagggacgagtggtccacgtcctctcacgtcctccaaccgaacggcccagtccggtcccttccccgtcgccgtcccgtcgcctaccgaggcgccnccgtaccgagcgcaacgcgccgccgtggcgtcgccgtggaccaaggtacctacgtccagaccgtacgcgtaacgtggacggcgggctagggcgaaggccgngacgtacgngnngnnnnn

SEQ ID NO: 213445 - DNA, 631 bp, Homo sapiens
  misc_feature: GYAE6OF02I9368.36.5.A05.1.454.CMB.1.raw
  modified_base (623)..(623): a, c, t, g, unknown or other
  misc_feature (623)..(623): n is a, c, g, or t
  modified_base (625)..(629): a, c, t, g, unknown or other
  misc_feature (625)..(629): n is a, c, g, or t
  modified_base (631)..(631): a, c, t, g, unknown or other
  misc_feature (631)..(631): n is a, c, g, or t
tcagtacgctgtctcacgaccggtgctcgatttagatagatagacagggtgtacacctgtggttctcggggctgccctttggttttggagatggttttctcgagtggggggctggaggtggggtggccaacataaaggaagatggaagtgaggactactatttggactctgtggaggggccgtattcaccgtctccagagacaacgccaagaaactcagtgtctctgacaaatgaaacagcctggagagtcgaggacgacggctgtgtattactgtgcgacccgtaggattaattgactaagtggggttactgcgtccgggcgggggcgcgtgggtagagtgtcgttttcgactacgttcggtcggggaccggaaaggggacgtacggttcggtaccgtacccgttcttcttccaccggtcctacccaccggaacgggccctacgtcccggttcccttcccccgtcggcccgtcccgtcgtcccgtccacgggacacccgacccgtccggagacgcaccgcggccggtccgcggtccgcgtccggtcggtacgtaacggaccttacctaccacgacgacgtccgtacgtgacgggcggtcgaggccggacggcgactacgagncnnnnngn

SEQ ID NO: 213446 - DNA, 674 bp, Homo sapiens
  misc_feature: GYAE6OF02F7Y4Q.36.5.A05.1.454.CMB.1.raw
  modified_base (493)..(493): a, c, t, g, unknown or other
  misc_feature (493)..(493): n is a, c, g, or t
  modified_base (665)..(665): a, c, t, g, unknown or other
  misc_feature (665)..(665): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccacgtcctccctgcccgtcacccttggacacgccggcctccatcctcctgcagtctagtcacagcctcctttgagtgataggaaacactacgtttgaatttggttactaacgagtacggccaggacctaattcctaccgaaggccgtaccttaatttaactctacggttttcgaaccgggtactcgtacggggtcccgatagtacttacgacggcgacgagtaggggttcacggctaaccgtggtactttccactacctagaaactcgagacgtagggtaggaggtacgaggtaaggtacgttgggtttaacggggtttagttaacgttnacgtacgtacggtacgtaacggttaacgtacgttacgtacggtacccgttaccggttaacttaccgttttacgggaccggtaaccggggaccgtacgtacggtacgggtacgtaacggttaacccgaaacgttaacgttaggtacggtcgtaccggactacccggttacgtntttacccgg

SEQ ID NO: 213447 - DNA, 950 bp, Homo sapiens
  misc_feature: GYAE6OF02GPA8S.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatggttgtgatgactcagtctccagtcctccctcgcccgtccacccttggacacggccggcctccatcctctcgctaggtctagtcactacgtcctttccttttcagttagactacggaaaacctaccttaacgttagtaagttttacggtttacaaacgtaggtacggacccgtaacggaccctaacgtcctacccggaacggtccgtaaccctttaaacgttttacttaccggttaacggttttacccggtaaacccgggtaccgttaccgggttaccggggggtaccccgaacgtacggttaacgttaccgaacgggccgggtacggaacggggtttcggggtacgaacggtaccgtaaccgtttaggtaaccgttttacccggaaaccttaacggttaacggtaaaaacgttacccgggaaacgggttaccgggtaaaggggggttacggggtaaccgggtccggtttaaaggggtaacggggttaagggttttagggggtttttaggggtttttaaacgttacccggtttaggtaccgttaagggttaccgtaacggtaaacgggtttacgaaaccggttttaccgttacccggggttacccctttaccgggtttaaacccgttttccgggttttaaacccgggggaaccccgggtacggggggtaaaccccttagggggtaacccgttacgggggaaaaccggtaccgttaaaacccccgggttaaacgggttaacccggttacgggggttacccgaacggttccgtaaccccggaaacccttttacggtcccgtttaaccg

SEQ ID NO: 213448 - DNA, 723 bp, Homo sapiens
  misc_feature: GYAE6OF02G6W78.36.5.A05.1.454.CMB.1.raw
  modified_base (163)..(163): a, c, t, g, unknown or other
  misc_feature (163)..(163): n is a, c, g, or t
  modified_base (474)..(474): a, c, t, g, unknown or other
  misc_feature (474)..(474): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
tcagtacgctgtctcacgaccggtgctcgatttagatagatagacaggggctgatcaggactcctcagttcaccttctcacaatgaggctccctatcagctccgtggggctgctaatgctcgtgggtcccagtatcaagcgagggatggttgtgagtcgactnacgtcctccgacgtcctccctcgacccgtctacccgttggacacgccggcctccatcctccgtcgctacggtctacgtcacgtccgtccttccttttacgaggtcgtaacgtaacggaaaacctaccttaacgttagttaaacgtttcggtttaaccaacgtaacggacggtaccgaacggtacctaactaccgtaccgaacgggtccgtaccttaaatttaccgtacgttacggttaccgaaccgggttactccgggtaccggggtacccgactacgacgttcgacggtcgacgtagggtacggtaccgnggtactacgttagtacttaccgaactacgtaagaaactcgaaggcgtacgggngtacggntagggagttacggttagggtttacggttatcgtagctagagtaccgtaagtaccgtacgttcggaccgttccggttaccgtacgttaccggttaggaaccgggtacgggtacctaggccggttggaacgttaccgtaccgaacgtacggttgaaccggcgttaccgaaccgttacgtacttacgttccg

SEQ ID NO: 213449 - DNA, 942 bp, Homo sapiens
  misc_feature: GYAE6OF02J3HYP.36.5.A05.1.454.CMB.1.raw
  modified_base (675)..(675): a, c, t, g, unknown or other
  misc_feature (675)..(675): n is a, c, g, or t
tcagtacgctgtctcacgaccggtgctcgatttagatagatagacaggggctgatcaggactcctcagttcaccttctcacaatgaggctcctgctcagctcctgggctgctaatcgctcgtgggtacccagtatcgaagcgagggtagttgttagtcgagttcgactcgtacgttcctaccgtacgttcccttcccgtcgtcccccggttacctacccgtttacggaaccgaccggtccccggtcccttaaccgtacttccttcccggtaacggtccgtaacgggttcctacgttaccaacctaccggtttccccttttccgttttaacgaggttacggtaacgttaaccgggtaaacccgttaccttaacgtttacggttaaacgttttacgggtttaccaaaccggtacggaccgggtacccgtaaccgggacccttaacggtacctaaccggtaacgggtaccttacctttaaacgttttaccgtaccgggtttaacgggtttaacccgtaacccggggtaccttttaccgggggtaccggggtaaccccgtaaggtaacgttcgggttaccggacggtaccggggttaccgtaaggggtttaccggacgtacgggttacctaaacgggttctttaaaccgttaccgaacgtaacgttaaacgggtaaacnccgggtttaacgggacgggtacgggttacgggaacgggttcggttaacggggttaggttacggttttagggtttacgggtttactaggttaccgtacgttaaacggtcggtaaacggttaacggttacctacgggtttaccgtaccggttaccgtttaccgggtaactttcgggtacggaccgtacgggtacgtcgtacgtacgggtaccagttaacccgtaacggcggtttccgacgggtcctaacgtcctaccgtacgtttccgg

SEQ ID NO: 213450 - DNA, 800 bp, Homo sapiens
  misc_feature: GYAE6OF02IXJCN.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtctccacgtctccctcgcccgtctacccgttggacacgccgcctccatcctcctgcaggtcctagtaccacacgtccttcctttcagtgtatacggtaaacctaccttacttgttaaactttggtttaccaaacgaacggtacggtaccgacggtacctaagtcccgaccaagggccgtaaccttaatttactcgtacggtttaccgtaaccgggtactccggtaccgggggtcccgaacgtacggtaacttccgaaggtccggtacgtagggtttcggggtaccgaacggtactaaccgttacggttaacttttacaacccgttaaacgtaagtaaaaccgttacgaacggtacgggtaacgggggtaaggtacgggtcggtacgggtaacgggttagggtttagggttttaaggggttttacttacggtttcgacgtagtaccgtacgttaacggtaccgtaagtccgttaccgggaccctttacggttaacgttaccgggttttaccggaccggggttaaaccgggaccgtaacggttccggtacggtaaaccgtaccggtaacccggtaaccggttaaacggttcgggtaacggtaccggttacccgtaccggtaaccctaccggtttacttccggg

SEQ ID NO: 213451 - DNA, 731 bp, Homo sapiens
  misc_feature: GYAE6OF02F3RFH.36.5.A05.1.454.CMB.1.raw
  modified_base (701)..(701): a, c, t, g, unknown or other
  misc_feature (701)..(701): n is a, c, g, or t
tcagtacgctgtctcacgaccggtgctcgatttagatagatagacaggggtgatcaggactcctcagttcaccttctcacaatgaggctccctgctcagctccgtggggctgctaatgctcgtgggtcccagtatcaagcgagggatgttgtgatgactcagtctccagtcctccctcgcccgtcaccttggacacgccggcctccactcctcctgcgtacggtctacgtcactacgtccttccttttcagtgactacgaaacctactacgttagtaagtttcgttacaacgagacggaccacggacctaatccgtaccgacggtaccgtaccttaagtttacgtacgttacggtttaccgtaacggtccgtcggttacggggtaccctacgtacgtacttcggacgtcgggacgtagggtcgggtacgacgtacgtaacgtcgttacttacgaacctagtaacgaaacttcggaaggtcggtagggggtaggcggtagttagggtacggtaagttgggtttacgggtttactagtttacgcgttaacgtggttaacaacggttacgtacgttaccgtccggttacctaccggtttaagtttaccggttccggaacgggacgggtaaacctgggtccggtaaggtaaccgtaaccggtaacccggtaacggttacgtttcggggaacgttacccggttacnccggttaccgttacggtttccgtacccggg

SEQ ID NO: 213452 - DNA, 837 bp, Homo sapiens
  misc_feature: GYAE6OF02IHH0D.36.5.A05.1.454.CMB.1.raw
  modified_base (224)..(224): a, c, t, g, unknown or other
  misc_feature (224)..(224): n is a, c, g, or t
tcagtacgctgtctcacgaccggtgctcgatttagatagatagacaggggtgatcaggactcctcagttcaccttctcaacaatgaggctccctgctcagctccgtggggctgctaatgctctgggtcccagtatcaagcgagggatggttgtgatcgactcagtctccacgtcctccctcgcccgtcctacccgttggacacgcccggcctccatctcctgcngtctacgtcacacgccttcctttcagtgatacggaaactaccttacttggtaatttcggtttacaaacgacggtacggacccgaacggtacccaacgttccgtaacccgaaacgggtccgttaacctttaacgttttaacctacgttaacgggttttaacccgttaaacccggggtaccgttaccgggtaccgggggggtacccccgtaacgtaggtaacgtttaccggagggaccgggtacgtacgggttacggggtacgaacgggtcctaacgttgttaacgttttaccgaacgtaaccgttaagtaaaacgtccgaaaggaccggtaaggtacgggtagggtaagggaccggttaaggaaggggttaggtttaacgggggtttttaggggttttaacttacggttagtacgtacgtaacggtacgtaaacgttaaccgtagttaaccggtaccggttacccttacccgggtttaacgtttaccggtttacccggggaacccggtaacggggtaaccaaccgggttaccggtacgggtaacgtacccggtaaacccgtaaaccggttacgtcggtaccggtaccgttaccgaaccgtaccctgttacccgg

SEQ ID NO: 213453 - DNA, 724 bp, Homo sapiens
  misc_feature: GYAE6OF02FNBWJ.36.5.A05.1.454.CMB.1.raw
tcagtacgctgtctcacgaccggtgctcgatttagatagatagacagggggtgatcaggactcctcagttcaccttctcacaatgaggctccctgctcagctcctggggctgctaatgctctgggtcccagtatcaagcagggatgttgtgatgactcagtctccagtctccctcgcccgtcacccttggacagcccggcctccatcctcctcgcaggtctacgtcacacgtccttcccttttcgacgttgattacggaaaacctaccttacttagtaattttacggtttacaaactaggacgggtacccaacggaccaacttctaccgaaacggtccgacctttaaatttacgttaccgtaagggttttacccgtaaaccggggtaccttccgtacggggggtaccccgaacacggtaacttcgaacggcggacgtagggtcgggtacagggtaccacgtgtactttacaacgtaacgtagaaactcgaacgtccgggaaggggtggaagggtctaggggaagtacggtttaggtttggggttttaacttacgttaggtccgagtgacgaagttaccaagtaccgtcggttaccctaccggttaacgttaccgtttacgggaccgggtaacgggggaaccgaggtacgttacgggaaacgtacgtaaacccgaacggtaagtcggtaccggtacgtacggtaccaccgttactccgtttaccg

SEQ ID NO: 213454 - DNA, 744 bp, Homo sapiens
  misc_feature: GYAE6OF02GJ3ES.36.5.A05.1.454.CMB.1.raw
  modified_base (615)..(615): a, c, t, g, unknown or other
  misc_feature (615)..(615): n is a, c, g, or t
tcagtacgctgtctcacgaccggtgctcgatttagatagatagacaggggtgatcaggactcctcagttcaccttctcacaatgaggctccctgctcagctccgtgggctgctaatgctctgggtcccagtatcaagcagggatgttgtgatgactcagtctcagtctccctgcccgtcaccgttgacacgccggcctcatctcctagcgtagtctagtcacgactccttcccttttcgagtcgaagtacggtaaaacctaccgtacttagtaagtttcggtttacaaacgaaggtacgggacccgtaacggacccgtaaagttaccttaacccggaaacggtccggtaaccctttaaagttttaagttaccgtaacgggtttttacccgttaaaaccccggggacttccgggttacccggggggttacccgaacggtaacgtaacgtttccgaacgggcggtccgaagggtttcgggtaccgaggtactaacgtacgtatttaccgaacctaacgtaagtaaaacgtcgaaggtacggaaggggtggaacgggcgtaggggagtaacgttgggtttagggtttaatcgtagccagtagagtacgtataaccgtntccgggtaccttaccgtaggtttaccttaggaccctaggggtaaccacggtacggtcggtaacggtaaacctaccgtaaacggaacttacggccgttaacgtcgtaaccgtaacctccgtttgtaaccg

SEQ ID NO: 213455 - DNA, 769 bp, Homo sapiens
  misc_feature: GYAE6OF02FVIDD.36.5.A05.1.454.CMB.1.raw
  modified_base (236)..(236): a, c, t, g, unknown or other
  misc_feature (236)..(236): n is a, c, g, or t
tcagtacgctgtctcacgaccggtgctcgatttagatagatagacaggggtgatcaggactcctcagttcaccttctcacaatgaggctccctgctcagctcctggggctgctaatgctctgggtcccagtatcaagcaggatgttgtgatgactcagtctccagtctccctgcccgtcacccttggacagccggcctccatcctcctgcaggtctagtcacacgccttccttttnacgtgactaggaaacctacctacttagtaaagtttcggtttacaactagacggccaacggccaaattccgtacccgaaaggtccgtaccccttaaagttttaacgtacgttaacggttttaccgtaaacccggggtacttccgttcggggggtaccccggtacgaacgtacgttacgaacggtccgggacgtagggttcggggtctaacgggacctcgtaggtacttttaccgaccgttaactaggtaaaacttcgaacggtacgaacggggttagggaagggtcgtaggtaacgggtaagttcgggttttaggggtttaacgttacgttaggcttaaggtcgtacgtaaacgggttaactaacgtaccgttacgggtcccttaaccggtttaccgtttaaccggttttcggaacccgggttaggggaaccccgttaagacccggttagggaaccgtaacgttaacccggtaaaccggtacttacggggtacggttccgttacggacccgtaacgttacgtccgtttaaccgg

SEQ ID NO: 213456 - DNA, 908 bp, Homo sapiens
  misc_feature: GYAE6OF02IKLD3.36.5.A05.1.454.CMB.1.raw
  modified_base (218)..(218): a, c, t, g, unknown or other
  misc_feature (218)..(218): n is a, c, g, or t
tcagtacgctgtctcacgaccggtgctcgatttagatagatagacaggggtgatcaggactcctcagttcaccttctcacaatgaggctccctgctcagctccgtggggctgctaatgctctgggtcccagtatacgaagcagggtatgttgtgatgactcagtctcctagtcctccctcgcccgtcctacccttggacacgcccggccctccatccncccgttgcgtaggtcgtacgtccaccgacgtcccttccttttcgacgttgaagtacggaaaactaccttacgttagtaatttggtttacaacgagacggtcaacggaccaactaccgtacgaacgggtaccgtaccctttaaactttacgtaccgttaacgggttttaacccgtaacccggggttacgttaccgggttcccggggggtacccgtaacgtacggttaacgttcggtaaccggtccgggtaccggtacggggtttacgggtccggaacgggtaccgtaaccgttacggttaacgttttaccgaacccgttaaacgttaaacggtaaaaacgttaccgtaaaccggggacgggttaacggggggtacgggtaacgggttaccgtaaggggtaagggttaacgggttttgggggttttaaacgggggttttttacttaaaggttccggttacgttaacggtacgggtaacggttaaacgggttaccttaacggttaccggtaccgggtacccctttaaccggttaaccgttttaaccggtttccgggaaacccgggtaacggggtacccgtagggtaccgttaacggggtaaacggtacccgttaaccggtaaaccggttaaccgggttccggtaacggggttacttacccggacccttaaccgtacgtttaccggtttacccg

SEQ ID NO: 213457 - DNA, 763 bp, Homo sapiens
  misc_feature: GYAE6OF02IHP8D.36.5.A05.1.454.CMB.1.raw
  modified_base (151)..(151): a, c, t, g, unknown or other
  misc_feature (151)..(151): n is a, c, g, or t
  modified_base (169)..(169): a, c, t, g, unknown or other
  misc_feature (169)..(169): n is a, c, g, or t
tcagtacgctgtctcacgaccggtgctcgatttagatagatagacaggggtgatcaggactcctcagttcaccttctcacaatgaggctccctgctcagctcgtgggctgctaatgctcgtgggtacccagtatacaagcagggatgttgngatgactcagtcctaccncgtcctcctcgcccgtctacccgttggacacggccgcctcactctctgctagtctagtccactacgtccctttctttacgagtagacgtaacggaaacctaccttaagttgttaacgttcgttacaaacgtacggaccggtaccgaacggtacctaacttccgtaccggaacgggtcctaacctttaactttacgtcgttaaccggtttaccgtaaaccgggtcttaccgggtacgggggtaccgaacgtaagtcgttacggacgggtccgtacggtagggttacgggacgtaggtcctaagtggttaccttaaccgaataccgtaaagtaaacgtacggtaacggtacgggtacggggtacgggtacgggtacgtacggggggggggtaacttagggtttacggggttttacgggtttaacgtttacgttcggtaacgtgtaacgtacgtaacgttacgtaacgttaccggtacgtacccgttacgttaccgttacggttacgtaccgggtacgtaacgtacgtacggtacggtaacgtacgtacctaaacggtacgtacggtacgtactacggtacgtactccgtacgttcg

SEQ ID NO: 213458 - DNA, 757 bp, Homo sapiens
  misc_feature: GYAE6OF02H3V30.36.5.A05.1.454.CMB.1.raw
  modified_base (122)..(122): a, c, t, g, unknown or other
  misc_feature (122)..(122): n is a, c, g, or t
  modified_base (704)..(704): a, c, t, g, unknown or other
  misc_feature (704)..(704): n is a, c, g, or t
tcagtacgctgtctcacgaccggtgctcgatttagatagatagacaggggtgatcaggactcctcagttcaccttctcacaatgaggctccctgctcagctccgtggggctgactaatgctntgggtcccagtatcgaagcgagggtatgttgtgagtcgtactcacgtctcctagtcctccctcgcccgtcacccttggacacgccgtcctcatctacctgctaggtctacgtacacacgtccttccttttcgagtagtagtaacggaaacctaccttaacgttagttaactttcggtttaccaaacgtaacggtacggaccgtacggaccgtaacttccaaccggtaacggtacctaccgtttaatttacgtacggtttaacggtttaccgtaaccggggtacttccgggttaccggggtacccgaagtcgtacttccggaggtcggtaacgtggttacggtgaccgtcacgtcgttaacgttccaacgtaactaacgaaactcgggatccgggtaaggggtggtacggtggtaaggtagggttaggttttacgggtttaacgggtttaacgtttaggacggttactaggttaccgaaacggttacgtaagtacggttacggtaccgtacccgttaaccgtagttaacccgggttcggtaacgtaccggggtaactcggtaccggttaggaacgttaaaccnccggtaaacgtaccggtggttaacgcccggttatcccgaactttgacgttccc

SEQ ID NO: 213459 - DNA, 810 bp, Homo sapiens
  misc_feature: GYAE6OF02F9PHY.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgactcagtcctccagtcctcctcgcccgtcaccctggacacgccggcctcctatcctcctcgcgaggtctacgtcacgacgtcccttccttttcgaggtacgagtacggaaaacctaccttacttagtaagtttcggttaaccaacgacggacggtccgaacggacctaacgtccgtaccgaaggtcccgtacctttaaattttacgtaccgttaacgggtttaccgtaaacccggggtcgttaccgggttaccgggggtacccgaacgtaagtacttaccgacggtccggacgtacgggtcgggtacgtacggactacgttacgttacgttaccaacgtaactaacgtaaaactcgaacggtacgggtaacggggttacggacgggtacgtagggtaacgggttaggtttaggggttttaagggtttaacgtttacgtcgtaagttacgtacggtaacggtaaacggtttactaccggttacggtccgttacccgttaccgttaaaccggtttacccggtttccggaaacccggggtacgggtaacccgttaacgggtcggtacgggttaaaccggaacccgttacccgggtaaaacgtacggttaggtaccggtaccgtaacccgggtaccaacccgtttcggttacgttacccgg

SEQ ID NO: 213460 - DNA, 655 bp, Homo sapiens
  misc_feature: GYAE6OF02FZTNA.36.5.A05.1.454.CMB.1.raw
  modified_base (640)..(641): a, c, t, g, unknown or other
  misc_feature (640)..(641): n is a, c, g, or t
  modified_base (649)..(649): a, c, t, g, unknown or other
  misc_feature (649)..(649): n is a, c, g, or t
tcagtacgctgtctcacgaccggtgctcgatttagatagatagacagggtgtacacctgtggttctcggggctgcccttttggttttggagatggttttctcgagtggggggctggagtggggtggccaacataaaggaagatggaagtgaggactactatttggactctgtgaggggccgattccaccgtctccagagacaacgccaagaaactcagtgtctctgacaaatgaacagcctgagagtcggaggacacggctgtgtattactgtgcgaccctaggatattgcaagtggggttactgcctccggcgggggcgcgtgggtagagtgtcgttttgactatcgtggggaccgaaggggacgagtcggtaccacccggttcttccttcgacgccccttacccgaaccgaaccgggccctacgttcccggttccctttaccccccggtcggcccgtccccgtcgtcccgtacccgaggaccgcctacccgtaccgacgaccggactaaccgacgggccggtcccggtcggccgtcgtcgtcggtaccgaacggtccttaccgtccgaacgactacgggacgttacgtggccggtacggggcgttacgggaccggtaagggccgccgtaagttacggnngacgtcancgctag

SEQ ID NO: 213461 - DNA, 806 bp, Homo sapiens
  misc_feature: GYAE6OF02JTVRH.36.5.A05.1.454.CMB.1.raw
  modified_base (71)..(71): a, c, t, g, unknown or other
  misc_feature (71)..(71): n is a, c, g, or t
  modified_base (175)..(175): a, c, t, g, unknown or other
  misc_feature (175)..(175): n is a, c, g, or t
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
tcagtacgctgtctcacgaccggtgctcgatttagatagatagacaggggtgatcaggactcctcagttcnccttctcacaatgagctccctgctcagctcctgggctgctaatgctctcgggtcccagtatcaacgcagggtatgttgtcgatgactcagtctacctgtctccngacccgtccaccgtgacagcccggctaccattccnctcgctaggtctacgtcacgtacgtccttcctttnagttcgactacggtaaaccaccgttacgttaggtaattttacgggttaccaacgtaacgcgggtacccgacgttaacaaccgttccaaccgtaggtaacctaccgttaatttacgacgttacggtttaccgtaaaccccggtgtcccgttaacggggggtcccaaaaccgtcgtaacttccgaacgggaccgcgttaaggttaccccgggtgaacggtactaccggttacacccgttttagaacgacccggtttaaagaaacgttaccaaggtccggtaaacggggttcggacggttaccgtagggaacggtttacgggtttacgggtttaacgggtttacgttaaccgtcggttagaacgtaccggtttacgttaacgggtaacgtaccggttaaccgtaacccggttcccgttaaccgggttacctttaaccggtttccggaaacggtaaccggtacccgtaggtaacggtaccgggtaacgttaacccgtaacgtaaaccccggtcggtttacgaaccgtcggttaacccgtaaccgtcggttaaccttgtttacccg

SEQ ID NO: 213462 - DNA, 663 bp, Homo sapiens
  misc_feature: GYAE6OF02GP8EX.36.5.A05.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (561)..(561): a, c, t, g, unknown or other
  misc_feature (561)..(561): n is a, c, g, or t
  modified_base (589)..(589): a, c, t, g, unknown or other
  misc_feature (589)..(589): n is a, c, g, or t
tcagtacgctgtctcacgaccggtgctcgatttagatagatagacaggggtcgagagaggagccttagccctggactccaaggcctttccacttggtgatcagcactgagcacagaggactcaccatggaagttggggctgagtctgggttttccttggttgttattttgtaaggtcgtcccagtgtgaggtgcagttggtggagtcgtgggggagcttgggtccgnggccgggggggtccctagngactcgtctgcncgagtcggtcncggtattcgtagttagnggtcattggntggagttcgctccgacncgcgtccggagggggggcagggngtgggtgcgtacgagtaaagganacgttggaagcgtaggacaagtgttaggacttcggtagtggacgggtacggacgtttccgtaccggtacgttccgaagtaccgaacgaaccgtaccgaagtaaacccgtagaacgtcggttacttcgcgtaaccttagaacttacaaagtccgtacggaagtcgaacggctaaggcttcggtaagcggtttatacggtttancggtcccgtaaccggagtttaacccggngttccggtaaggtaggttacggtaacgtttcggaacgggtcccggtacggttccggggcgtggttaagggtccg

SEQ ID NO: 213463 - DNA, 764 bp, Homo sapiens
  misc_feature: GYAE6OF02GBAFN.36.5.A05.1.454.CMB.1.raw
  modified_base (717)..(717): a, c, t, g, unknown or other
  misc_feature (717)..(717): n is a, c, g, or t
tcagtacgctgtctcacgaccggtgctcgatttagatagatagacaggggtcagagaggagccttagccctggactccaaggcctttccacttggtgatcagcactgagcacagaggactcaccatggaattggggcctgagctgggttttccttgttgttattttagaggtgcccagtgtgaggtgcagttggtggagtcgtgggggagtcgttggtccaggcccggggggggtccctggaggactctccgtgcgcgagccgtcgtggattcgtaggtttagtggtctagttggtatggtagttggccgtccgcccgaggtccgtccggggagggggggggtcctgggaggttggggtacggaccgaacgtaaggtaaaacggaaggacgtagggaacggtaggtaaggtaccttaacgtttacgtttacgggtaccgttacgtacgggtagggtaccggggtccgttaaacgttccgtaaccccgggttcctacccggaaggtaaccggaacccgtaaaccgacccgtaaacgtaaaccgtcggtaacggttgtcccgttacgtacggaacctaaagttaaccgaaacgtacgccgttagaacggtccgtaacggacggtaaccgacggtcccttagggttcgttaacgtttacgcggttacgccgttaacggtacgttagtacgttcggaaccgtaggggttacgggttacccncggttcccggtccggggtaccgggtcgtacggttagggaccgttagg

SEQ ID NO: 213464 - DNA, 819 bp, Homo sapiens
  misc_feature: GYAE6OF02HOPA4.36.5.A05.1.454.CMB.1.raw
  modified_base (635)..(635): a, c, t, g, unknown or other
  misc_feature (635)..(635): n is a, c, g, or t
  modified_base (662)..(662): a, c, t, g, unknown or other
  misc_feature (662)..(662): n is a, c, g, or t
tcagtacgctgtctcacgaccggtgctcgatttagatagatagacaggggctgatcaggactcctcagttcaccttctcacaatgaggctccctgctcagctccgtggggctgctaatgctcgtcgggtcccagtatcaagcgagggtagttgttgtgatgactcacgtcctccacgttcctcccgtcgtcccgtcctacccgttggaccacggcccgcctccatcctcctcgcgtaggtctacgtcacgtacgtccctttcctttcgagtacgtaacgtaacggaaaacctacccgttagtttagtaacgttttcggtttaaccaacgaacggtacggcccgtaacggtacccaacgttacccgtaccgtaaccgggtaccgttaccctttaaagttttacgttaccggttaacggttttacccgaaccggggttacccgttccggggtaccggggtacccggaattacggtacgttccggaggtccggtagtcgggtcgggtacggacgtaccgtacgttacgttacgtttaccaactaaccgtaaagtaaaaccgtgtaaccggaggacggggtaagggcgtaggttagggtaagggttaggtttcggggttttaaggtttacgtacggttnaccgtagttacggaacgttaaacggtntaaccggttacggtccggttccgttaacggttccgtttaacgggttcccgaacgggtaaccgggaccgacgttacgggtaacgttaaccggaaccttaaaccccggtaacggttaaggtcggtacgtaccggaccgttccgttaacgtacctttcgg

SEQ ID NO: 213465 - DNA, 693 bp, Homo sapiens
  misc_feature: GYAE6OF02IQ1P9.36.5.A05.1.454.CMB.1.raw
  modified_base (135)..(135): a, c, t, g, unknown or other
  misc_feature (135)..(135): n is a, c, g, or t
  modified_base (145)..(145): a, c, t, g, unknown or other
  misc_feature (145)..(145): n is a, c, g, or t
  modified_base (294)..(294): a, c, t, g, unknown or other
  misc_feature (294)..(294): n is a, c, g, or t
tcagtacgctgtctcacgaccggtgctcgatttagatagatagacaggggctgatcaggactcctcagttcaccttctcacaatgaggctccctgctcagctccgtggggctgctaatgctctgggtcccagtancaagcgaggntgttgtgatgactcgtagtctccagtcctccctcgcccgtccacccgttggacacggccggtcctccactcctccgtgctaggtctacgcacgcgtccttctttcagtgataggaaacctccttacgttgtaagtttcggttacaaagnggacgaccgaggaccaacgtccgtaccgaaggtccgtaacctttaaattctacgttacggtttaaccgtaacggtctacgggtaccgggtacccgatagtctacgacggcggcgtagtcgggtcgaggtacctactacggtacgtttcaaccgtaactaacggtaaaagtcgaaggacgggtaaggggtcggaaggtacgttggaaggttgggtttagggtttacgggttttagttacgttacgtgtacggtaggtacgtaaggtactacgtacgtaccgtccgttaccgttacgttccggtttaccggacggtaacgggtacccgtagtacggtacgggtaactaacctaaccggaagtaccggtggttacgtaccgtacggaccctcgtacgttccg

SEQ ID NO: 213466 - DNA, 839 bp, Homo sapiens
  misc_feature: GYAE6OF02GYOUM.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctcgtgggtcccagtatcaagcgagggtatgttgtgatgactcagtctcctagtcctcctgacccgtctacctgcacgccggcctccatcctcctgacgtagtcgtagcacacgtcccttcgtttcagtagactacggtaaactaccgttacgttagttaacgtttcggtttactaacgtaacggacggacccgacggtacccgtaacgtacctaccgaaacgggtaccctaccgtttaaacttttacgttaccggttaacgggtttaacccgtaacccggggtaccgttacccggggttccggggtaccccggtacgtaacggttacgttacggaccgggttccggaacggtacgggttacgggtaccggtaacggtaccgttaccggttcgtaacgtttttcccgaaaccgttaacgtttaaacggaaaacgttaccggtaacggtaacgggttacgggggtaacgggtaccgggtacggtaacggggtaacgggttaaggtttacgggttttaaggggtttaacgttaccgttggtacgttacgtacggtaacgtaacggttactcgttaaccgtccggtcccgtttaaccggttacgttaccggtttaacgggtaccggtaacgggtaccgaacgtaccgggttaacggtaacgtaaccgtaccgttaaacggtccggtaggtccgggtacttaacccggctaccgttagttcccgg

SEQ ID NO: 213467 - DNA, 647 bp, Homo sapiens
  misc_feature: GYAE6OF02GU6YZ.36.5.A05.1.454.CMB.1.raw
tcagtacgctgtctcacgaccggtgctcgatttagatagatagacaggggtcagagaggagccttagccctggactccaaggcatttccacttggtgatcagcactgagcacagaggactcaccatggaattggggctgagctgggttttccttgttgttattttagaaggtgcccagtgtgaggtgcagttggtggagtcgtggggggaggcgttgggtccaggcccggggggggtccctggagactctcctgcgcagcgtctggattcaggtttagtggctattggatgagttggctccgccaggctccggagggggggggctgggaggtgggtggccaacgagtaaagggaagatagggaagtaggaggactactagtttggacttcgtggtggagggggccgtagttccacccgttctaccgtaggacgaaccaacgaccaacgaaacctacgagtcgtctcgtgacaaatacgaacagaccgtagagacggtacggaacggaccgacggtctaggttagttagttacgttaggtcgaccggtacccgttaggtaacgttagtttagaccgttaagggttaggggggtttactcgggtccggttccggggaccggggggtccgtacgggttaggggttaacgg

SEQ ID NO: 213468 - DNA, 891 bp, Homo sapiens
  misc_feature: GYAE6OF02HD3W4.36.5.A05.1.454.CMB.1.raw
tcagtacgctgtctcacgaccggtgctcgatttagatagatagacaggggtgatcaggactcctcagttcaccttctcacaatgaggctccctgctcagctcctggggctgctaatgctctgggtcccagtatcaagcagggatgttgtgatgtactcagtctccagtcctcctcgcccgtcctacccttggacacggccggcctcactctcctggctaggtctagtcacacgtccttccttttcacgtcggatacggaaacctaccttacgttagtaacgtttcggttacaaccgtaggtacggacccaacggaccctaaacgttccgtaaccggaacggtcccggtaccctttaaagttttacgtacccggtttaacgggttttaacccgtaaacccgggggttactttccgggtacccggggggttaccccggtaacgtaacggttaaccgttaccggtaacgggtccgggtaccggtaaggggtttaccggggtccgtaaggggtaccctttaacgttcgtttaaacgtttaccaaccggtttaacgtaaacggtaaaacgttcggaacggtaccggggtaaaggggggttccgggaagggttcggtaacggggtaacggggtttaggttttaccgggggttttaacgggggtttttaaattacccggtaggttaaccgtaagggttcggtaaacgggtaaacgggttaaccgttaacgttacccgggtccggttaccccttaacggttaacgttttacccgggttacgggaccggaacgggtacctacgggtcggtaacgggtaactaacccggtaaccgtaaaccgggtcgtttacgggtccggtacggttacccgaaccggtttactaccgttagtttacccgg

SEQ ID NO: 213469 - DNA, 779 bp, Homo sapiens
  misc_feature: GYAE6OF02G68G5.36.5.A05.1.454.CMB.1.raw
tcagtacgctgtctcacgaccggtgctcgatttagatagatagacaggggctgatcaggactcctcagttcaccttctcacaatgaggctccctgctcagctcctggggctgctaatgctctgggtcccagtatcaagcgagggatgttgtgatgactcagtctccagtcctccctgcccgtcacccgttggacacgccggcctccactctcctgcgtaggtctagtacacgtacgtcccttccttttacgagtgatacggaaacctaccttacttagtaactttaggtttacaacgtaggacggtacccacggtacctaaacgttccgtaacccgaacgggtcccgttacctttaagttttacgtaccgttaacggtttacccgtaaacccggggtaccgttaccggttaccgggggtaccccggaactaacggtacgttacggacggccgggacgtacgggttcggggttaccaggggtacctaacgttacggtaacgtttccaaacgtaccttaagaaaactcgaaggtacggtagggggtacgacggtcgtagggtacggtagtttggggttttacggtttaactgtacgattaggtaccgtaaggtaacgtacgtacgttacggtaccgttaccgttaccgttaacttaccggtttacgggacccgtaagggggtacccctaagggtcccgggttaaggaaccgttaaccgtaaccggtaaacggttacgtcggggttacccgtaggtaaccgtacctaccgtacgttacccgg

SEQ ID NO: 213470 - DNA, 774 bp, Homo sapiens
  misc_feature: GYAE6OF02F0P5K.36.5.A05.1.454.CMB.1.raw
tcagtacgctgtctcacgaccggtgctcgatttagatagatagacgagggggtgatcaggactcctcagttcaccttctcacaatgaggctccctgctcagctcctgggctgctaatgctctgggtcccagtatcaagcagggatgttagtgatgactcagtctcagtctcctcgccgtcacccttggacacgtccggcctacctagtcctcctaggcgtacggtctaggtaccactacggtcccttacccttttagacggttgaacgttacgggtaaaaccctcccttaaccgtttagaacgttttacggttccaaacgacggtaacggtccgaacgggtacctaacgtacctacgaacggtacgtaccgttaacttacgtactaacggttacgtaaccggggtactccggttaggggtacccggtacacggtacgttcgtaacggcggtcgtaacggtgggtaccgtacggctaacgttcgtaacgtttcgaaaccgtagtaacgtaaacgtacgtacggtaacgacggggttacggtacggtacgttacgggtacggttacggttaggttttagggggtttaacgttacggttacggtacgtacgtacgtaaccgaaacggttacctaacggttaccgtaccggtccgttacgttaaccgtacggttttccgaaccggtacgggaaccgtacgtacggtacggaacggtacgtaaccgtacggttaacgtcggttacggaccttcggacccgtaccgtaccgtacgttccg

SEQ ID NO: 213471 - DNA, 1099 bp, Homo sapiens
  misc_feature: GYAE6OF02HWKRK.36.5.A05.1.454.CMB.1.raw
  modified_base (137)..(137): a, c, t, g, unknown or other
  misc_feature (137)..(137): n is a, c, g, or t
tcagtacgctgtctcacgaccggtgctcgatttagatagatagacgagggggtgatcaggactcctcagttcaccttctcacaatgaggctccctgctcagctcgtgggctgctaatcgcttcgtgggtacccagtntacaagcgagggtattggtttcgtaggtatggtacctctacggttcctacctaacggtccctttcccccgttcggtcccccgttaccgtacccgttacgggaccgaacgggccccgggtcccttaacccgtactttcccttccgtacgggtaccgttacgggttaccgttaacggtccccgtaaacccgtaccggttacccccttttcccgttttttcgaacggtttacggaacggttttaaaacccgggaaaaccttttaaccccgttaacgttttttaacggggtttaaaccgttttttccggtttaaaccccgtaaaacgaacgggggttaacccggaccccgggtaacgggtaaacccccgtttaaaacttcccgtaaccccgggtaaaccgggtaacccgtttaaacccgttttttaaaactttcggtttaaaccccggttttaacgggtttttaaaccccgggaaaaccggggtttcccccggtttaacgggggttaccccgggggtaaccccgggtacttaaacggttaaaccgttttaccgggaacgggtccgggttaaacggggttcggggttaaacggggttccggaaacgggtccgttaaacgtttcgggtttaaccttttaacccggaaacgtttaaacggtaaaccggttaaaaacgtcgggttaaacgggaacgggttaacgggggtaacgggttaacgtacgggttaagggtagggtttaacgggttttaacgggttttaggggtttaaccttgggtaacgttaacggtttcgagggttaaacgttaaaggttaccgttaagttccgggtaccgtttacccggttaagtttaacccggttaccgttttagggaacccgggacggtaacgttacgacgggttacgggaactaacccggtaacctaaccggtaagtccggttcaacggtccgtactactacgttctccg

SEQ ID NO: 213472 - DNA, 496 bp, Homo sapiens
  misc_feature: GYAE6OF01ANJDQ.34.59.F04.1.454.CMB.1.raw
  modified_base (357)..(357): a, c, t, g, unknown or other
  misc_feature (357)..(357): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaagggtcctcggttcttgatgaaacttgacagtgatggcagccacatcgaagggggacggatccctaatcgcttctcaggctccagctcgtggggctgagcgctccctnatcatctccagccctcagtctgaggatgagctgacttattattgcaggacgtggggctacgtggctattcgagggttgtcggcgggaggacccaaggttgaccgtcgtgggtcacggcccaaggctcgccccgtggtcc

SEQ ID NO: 213473 - DNA, 508 bp, Homo sapiens
  misc_feature: GYAE6OF01CXKDR.34.59.F04.1.454.CMB.1.raw
  modified_base (364)..(364): a, c, t, g, unknown or other
  misc_feature (364)..(364): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagcaacagccacggaagggtcctcggttctgatgaaacttgacagtgatggcagccacagtcgaagggggacggactcccgtaatcgcttctcaggctccgagctcgtggggctggacgccgctccctnatcatcctccagccctcagtctgaggatgaggctgtacttattattgtcaggtacggtgggcagtgctagtcgaggttcgtcgggcggaggaccgtagttcggaccgtcgtgggcgacgcccgaggcctccggccccgtggtcc

SEQ ID NO: 213474 - DNA, 623 bp, Homo sapiens
  misc_feature: GYAE6OF01B5ZF5.34.59.F04.1.454.CMB.1.raw
  modified_base (405)..(405): a, c, t, g, unknown or other
  misc_feature (405)..(405): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaaacacgaccgacgggaacgggtcccttcggttcttggaatagtaaacttgacagtgatggcagccagagtacggaagggggacggtactacccgtaatcggtcttcgcgacggcctaccgagcctcggtcggggctggacggccgtcctccctnacttccacttcctcccagtccctcgacgttcgtaggaaggtactggacggtctacggtaactttagtttagttcggtaacgtacgggtaacgggttcggggacacggttcgggtactacgttcggtacggggttgggttccgggaggggtacgggtaaccgtacggttcgggtacccgttccgggtcgggtacaccgggtaccccggaaggtccccgg

SEQ ID NO: 213475 - DNA, 555 bp, Homo sapiens
  misc_feature: GYAE6OF01BQMX7.34.59.F04.1.454.CMB.1.raw
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaaggtcctcggttcttgatgaaacttgacagtgatggcagccacagtcgaagggggacggatccctaatcgcttcncaggctcgagctcgtggggctggacgcgctccctnatcactcctccacgtccctcagtcctggaggatggacggtctagtacttattattgtacgaggtacggtggggactacgtggactagttcgaggttcggttcgggacgggtagggaccgtaaggttccggaacccgttccggtgggaccacggcccgaacgggtccctacccggccccccgttgggtccctacccg

SEQ ID NO: 213476 - DNA, 583 bp, Homo sapiens
  misc_feature: GYAE6OF01CHSW2.34.59.F04.1.454.CMB.1.raw
  modified_base (335)..(335): a, c, t, g, unknown or other
  misc_feature (335)..(335): n is a, c, g, or t
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccgaacggaagggtcctcggttcttgatagaaacttgacagtgatggcagccacagtacggaagggggacgggactacccgtaatcgtcttcncgaggctccagctcgtgggctgacgcgcctccctnactcactcctccacgtccctcagtctggaggtntggacggctagtaactttattagttgtacagggtaccgggtggggacctacggttgggactagttccggagggtttcggttaccgggacgggaacgggtaccgtaagggtttcggaacccggttcgtacggggtaccacggtaccccgaagggtccctcccggtccccccgttggtaccc

SEQ ID NO: 213477 - DNA, 734 bp, Homo sapiens
  misc_feature: GYAE6OF01C5YKH.34.59.F04.1.454.CMB.1.raw
  modified_base (405)..(405): a, c, t, g, unknown or other
  misc_feature (405)..(405): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagcaacagccaacgggaacgggttcctcggttcttgatgaaacttgacagtgatggcagccacagtacggaaggggggaccggactaccccgtaagtccggtcctttccgtcgacgggtccttaccgaggtccgttcggtcgggggcctgggacggccgtccttcccctnaacttcctacttcccgtaccacgcccttacccagttccgtggaggatgggacggtcttaggtaacctttagtttaagtttcggtacgtaacgggtaaccgggttcgggggtacctacgggttacgggacttaacgttttccgggaagggggttttccgggtttacccggggggaaccggggttaaacgggggtaaacccccgttaaaaggggttttcccggaacccccggggtttccgggttacggggggttaccccaaacccggggtcccccggtaaaacggggtcccctttccccggggccccccccggtttcgggggttaaccccc

SEQ ID NO: 213478 - DNA, 578 bp, Homo sapiens
  misc_feature: GYAE6OF01EDSX8.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaaggtcctcggttctgatgaaacttgacagtgatggcagccacatcggaagggggacggataccctaatccgcttctcgaggctccagctcgtgggctgacgcgcctccctcactcactcctaccacgtccctccgagtcgtaggacggatggaggtcttaggactttaagtttattggtacgagggtacgggtggggacctacggttggactagttcggagggttcggttcggggacgggtaacgggtaccgtaagggttcgacccggttcggtacggggtaccaccggtaccccgaagggtcccttcccggccccccgttgggtaccc

SEQ ID NO: 213479 - DNA, 628 bp, Homo sapiens
  misc_feature: GYAE6OF01BB7AU.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccaggaagggtcctcggttcttgatgaaacttgacagtgatggcagccacagtcgaagggggacggatcccgtaatcgcttctcgaggctccgagtctcgtggggctggacgccgctccctcactcactcctccacgtcccctacccgagttcgtaggaacggatcggaggtcctaggtaacctttaagttttattcggtcgaagggtaccgggttcgggggacctacggttcgggtacttagtttaccggaaggggtttcggttaccggggaccggggtaacgggtaacccgtaaagggtttccggaccccgggttccggttacggggtaccaaccgggtaccccgtaaacgggtcccgtcccgggtccccccggttcgggtccc

SEQ ID NO: 213480 - DNA, 600 bp, Homo sapiens
  misc_feature: GYAE6OF01CLQ03.34.59.F04.1.454.CMB.1.raw
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagcaacagccacggaaggtcctggttctgatgaaacttgacagtgagtggcagccacagtacgaagggggacggactcccgtaatcgcttcncgacggctccgagctcgtggggctgacgcgtcctccctnactctactcctccaacgtccctaccgagttccgtaggaacgggtactggacgggtcttaggtaacctttaagtttacgtttcgtacgtacgggtacgggttcggggactacggtacgggtctagttccggtagggttcggttccggggacgggtacgggtaaccgtaagggttccggaacccggttcggtacgggtacaaccggtcccgaaagggtccccg

SEQ ID NO: 213481 - DNA, 741 bp, Homo sapiens
  misc_feature: GYAE6OF01AV3AO.34.59.F04.1.454.CMB.1.raw
tcagtacacgtgatcacgaccggtgctcgatttagtacacacacttagggattggggtctgcaccatggcttggaccccactcctcttcctcaccctcctcctccactgcacagggtctctctccagcctgtgctgactcaatcgccctctgtctctcgcctcccgtgggacgcctcggtacaagcctccacctgcactctgagcagtagaacacatccacctacgccatcgcatggcatcagacaacgacgccgaacggacggtccttcggtttctagaatagtaaacgttgaacgtaggtagagtacggacacgccaacgtagtacgggaaacgggggacggaacttaccctaagtcgtcttcgacgtacggcctacgacgtccgttcggtcggggtacctagggaccggtcccgtcccttacccctactaccttacgtaacctttcccgacccgtacggcccctttacgaaggtccgtaggaagggtacctgggtaacggttctacggtaactttaagtttcgtaggaccggttaacgggcggggtcgggtaccctaggttccgggacttacggttgggacggggtttcgggttaccggggacggggtaaccgggttaaccgtaacgggttttccggggaaccccggtttcggggtaacgggtaccccgtaaccgggtaccccgtaaccgggggcccttacccccgggtaccccggttcgggtaccccttaccccggg

SEQ ID NO: 213482 - DNA, 644 bp, Homo sapiens
  misc_feature: GYAE6OF01EPIBX.34.59.F04.1.454.CMB.1.raw
  modified_base (299)..(299): a, c, t, g, unknown or other
  misc_feature (299)..(299): n is a, c, g, or t
tcagtacacgtgatcacgaccggtgctcgatttagtacacacacttagggattggagtctgcaccatggcttggaccccactcctcttcctcaccctcctcctccactgcacgagggtctctctcccagcctgtgctgactcaatcgccctctgtctctgcctcctgggagcctcggtcaagctcacctgcactctgagcagtgaacacatccacctacgccatcgcatggcatcagcaacagcccgaacggaaggtcctcggttctaggatgaaactttgacagtgatggcagaccanatcgaaaggggacggactaccctaatccgcttcgcaggcctccgagctcgtgggctgacgtccgcctccgtcatcgtatccctccgacgtccctccgaaggttccgtaggacggtatcggacggtctacggtaacgtttaagtttacgttggtaccgaggtaaccgggttggggacctacggttcggacttacgttaccggtacgggttcgggtttacccgggacgggttaaccgggtacccgtaacgggtttcggaacccccggttccggttacggggtacccaaccgggtacccccggtaaagggtccccccgttcccgggcccccccgttcggggttacccc

SEQ ID NO: 213483 - DNA, 578 bp, Homo sapiens
  misc_feature: GYAE6OF01AOC0M.34.59.F04.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacngccaggaggtcctggttctgatgaaacttgacngtgatggcagccanatcggaagggggacgatcccgtaatccgcttcgtcgaggcctccagtctcgtggggctggagtccgtcctccctacagttccaacttcccgtacccgacgtccccttaccgaggttcccgaggacgggtactcgggaacggtccttaggtaaccttagtttacgtcggtacaacggtaccgggttgggacctaacgtgggaccttaggttcgagggttcgtacgggacggacgggtacctaggttcgaccggtcgtagggcaccgtccgaggtcctccgccccgtggtcc

SEQ ID NO: 213484 - DNA, 863 bp, Homo sapiens
  misc_feature: GYAE6OF01D18P8.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaaacacgaccgaacgggaacgggtcccttacgggtttcttaggattacggaaaactttggaacctaaggtggaagtcgggacaacggacccaacgaacgtaccgggaaaagggggggaccgggtaactttaacccccgtaaacgttccggtaccttttaccggtaccgtaacggggtcccttcccgtaacggtcccgttcgggtcggggggtaccctgggaacggcccggttaccccttcccccgtaacgtacttacctaaccttcccgtaccctaacggtccccgttacccgtacggttaccgttacggggaaacgggtacttacggggtaacggtaccgttacggttaaaccgtttaacgtttttaagtttaccggttaacggtaacggggtaaccgggggttaccgggggtacttaacccgggttacggttaccgttaacggtttaccggttaacggggttcgggtttaccggggggtacccggggtaaacggggttaaccccggttaaacgggtttacccgggtacccgggtttccgggttacccgggggttaccgaaccccggtacccgggtaaaccggggtcccgttaccccgggtcccccccggtacgggttacccccg

SEQ ID NO: 213485 - DNA, 708 bp, Homo sapiens
  misc_feature: GYAE6OF01ETPN3.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagcaaacagccgaacgggaagggtcctcggtttcttgatgaaactttgacaggtgagtggcagccacgagtcggaagggggacggactcccgtaagtccgtcttcctcgaggcctccgagtcctcggtggggctggacggccgccgtcccctacacttccacttcccctaccgacgtccccttacccgagttccgtagggaacgggtattacggggaacggtccgtttacggtaaccttttaagtttttacgttcggtaccgtaaggggtacccggggttcgggggacctacggttcgggaccttaaggtttccggaaggggtttcgggttaccgggggaccggggtaacggggttaacccgttaaacgggtttcccgggaaccccgggtttccggtacgggggtacccaacccggggtacccccgtaaaggggttcccccttacccggggtcccccccgttggggttacccc

SEQ ID NO: 213486 - DNA, 718 bp, Homo sapiens
  misc_feature: GYAE6OF01C0A26.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacgggaacgggtcctcggttcttgatagtaaacttgactaggtagagtggctacgaccaacgataccgggaaaggggggaccggacttaccccgtaagtccgtccttcgtacgacggtcctccgacgtcgtacgtgggggctagggacgtccgtccttcccgtctaacttccgacttccctacccgacgtcccctaccgtacggttccgtgggtaacggtactacggggtacggtaccttaaggtaaccttttaagttttaacgtttaggtaaccgtaggggtacccggggttacgggggtaccctaaccggttcggggtaaccttaagtttccgggtaagggtttccggggttaccgggggaccggggtaacggggtaaacccggttaacgggtttcccgggtaccccggttccgggttacgggtacccgtaaccgggtccccggtacggggtaccccgg

SEQ ID NO: 213487 - DNA, 545 bp, Homo sapiens
  misc_feature: GYAE6OF01EDBB4.34.59.F04.1.454.CMB.1.raw
  modified_base (183)..(183): a, c, t, g, unknown or other
  misc_feature (183)..(183): n is a, c, g, or t
  modified_base (313)..(313): a, c, t, g, unknown or other
  misc_feature (313)..(313): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctcctgggancctcggtcaagctcacctgcactctgagcagtgaacacatccacctacgccatcgcatttggcatcagacaacagaccacggaacgggtcctcggttcttgatagaaacttgacagtgagtggcagccanagtcggaaggggacggactacctaagtcgtcttcgcaggcctcgagcgtcgtggggctggacgcgtcctccctcatccgactcctaccacgtcctccgagtctggaggtatggaggcgtacgtacttatttagtcgtcgtaggtacggtcgggactacggtgactagttcgagggttggtcgggaggacgggtaccaggttcgaccggtcgtacggtcacgccgaggtcccg

SEQ ID NO: 213488 - DNA, 571 bp, Homo sapiens
  misc_feature: GYAE6OF01CW3WT.34.59.F04.1.454.CMB.1.raw
  modified_base (210)..(210): a, c, t, g, unknown or other
  misc_feature (210)..(210): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
  modified_base (488)..(488): a, c, t, g, unknown or other
  misc_feature (488)..(488): n is a, c, g, or t
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctcgccctcccgtgggacgcctcggtacaagcctcacctgcactctgagcagtnaacacatccacctacgccatcgcagtcggcatcagcaaacacgccgaacgggtaacggtccttcggttcttagacgttagtaaacttgacagtgagtggcagccaagtagacggaaaggggcggtactacccgtaatcggtctttcgacgacggtcctaccgaggtcctcggtcggggcttaggaccgtccgcctccctanactccaacttccaccacgtccctacgagttcaggagntggagtctagacttattgtcgacgaggcgggtggactagnggactgttcgaggttcgtacggacggagaccgtagtcccgacggtcgtagggccacggtcccagtccncccgtcccgngtccc

SEQ ID NO: 213489 - DNA, 696 bp, Homo sapiens
  misc_feature: GYAE6OF01EVD1O.34.59.F04.1.454.CMB.1.raw
  modified_base (291)..(291): a, c, t, g, unknown or other
  misc_feature (291)..(291): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaggtcctcggttcttgatagaacttgacagtgatggcagccanagtacggaagggggacggactacccgtaagtcgtcttccgcgaggtcctacccgagtccgttcggtcgggggcttacgggacggtcccgcccgttcccctacgtacttccgaattccccttacccgaaccggtcccccttacccgaacggttccgtacggtaacggggtatacgggaacggtccgttagtaaccgtttaattttacgttcggtacggaacggtcggggtacggggcctacgggtcggtacgttacgttcggtaggggttcgttcgggggtaccgggaaggggtaacccgttaagggtttccgggtaacccggtttaccggtcgggggtacccacgggtacccccgtaaaggggtccccttacccgggtccccccggttcggtcccgttaccccgg

SEQ ID NO: 213490 - DNA, 628 bp, Homo sapiens
  misc_feature: GYAE6OF01AFGC8.34.59.F04.1.454.CMB.1.raw
  modified_base (170)..(170): a, c, t, g, unknown or other
  misc_feature (170)..(170): n is a, c, g, or t
  modified_base (484)..(484): a, c, t, g, unknown or other
  misc_feature (484)..(484): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgcctctgtctctgcctccctgggancatcggtacaagctacacctgccactctaggagcgagtacgaacactactccacccgtacgccagtcgactagtcggcatcgagacaacgcgccgaacgggtaacggttcctcggttactagagtacgaaacttgaactagtagtagtggacacgccaacgtacgtacgggaaggggtacgactaccctagtcgtcttcgacgtacgcctacgagtcgtggttcgggctacggcggtcctcctccctatacgttcacgttccctaccgacgtccctacgtagtcgtaggacgtgtaggtcgtctagtaacgttntttagtcgtacgacgggtacggtggtcctaggtcgtactagtcggtacgggtcggttccgggaggtaacggtccgtaaggttccggaacccgttcgggtaacggtaccgacggacccgtacggccgttcccggtcccgttaccg

SEQ ID NO: 213491 - DNA, 608 bp, Homo sapiens
  misc_feature: GYAE6OF01BPILN.34.59.F04.1.454.CMB.1.raw
  modified_base (318)..(318): a, c, t, g, unknown or other
  misc_feature (318)..(318): n is a, c, g, or t
  modified_base (407)..(407): a, c, t, g, unknown or other
  misc_feature (407)..(407): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctcccgtgggagcctcggtcaagctcacctgcactctgagcagtgaacacatcacctacgccatcgcatggcatcagacaacacgccgaacgggaacgggtccttcggttcttgataggaaacttgacaggtgatggacagccanagtacggaaagggggcggtactacccgtaatccgtcttcgacgacggcctccgagtctcggtcggggctggacgtccgtccctccctanatccagtcctaccgacgtccctcgagtcgtaggacgtagtggacgtctagtaacttgttagttcggtactaagggtcgggttcggggacctacggtgggacttagttacggaggggtttcggtaccggggacggtacgggaaccgttaacgggttccgacccggttcggtagggtaccacgggtccccgaaggggtccccg

SEQ ID NO: 213492 - DNA, 595 bp, Homo sapiens
  misc_feature: GYAE6OF01CVH3F.34.59.F04.1.454.CMB.1.raw
  modified_base (434)..(434): a, c, t, g, unknown or other
  misc_feature (434)..(434): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagcaacagccacggaacggtcctcggttcttgatagtaaacttgacagtgatggcagccaacagtacggaacgggggacggactcccgtaatccgcttctcgacggcctccgagtcctcggtcggggctggacgccgtcctccctcactcacgtcctccgacgtccctccgtagtcgtggaacggngtaggacgtctagtaacttagttagttcgtacgagggtacggtgggaccacgtcgacgtacgtcggtagggttcgggttacgggacgggtaacgggtaacccgttaggttaccgggtacccgtcgggtacgggtacgacccggtcccggaacgggtccccg

SEQ ID NO: 213493 - DNA, 694 bp, Homo sapiens
  misc_feature: GYAE6OF01DGX9L.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatccgccctctgtctctcgccctcccgtggggacgcctcggtcaagcctcacctgccactctggagcagtagaacacatccacctacgccatcgcagtcggcatcagacaacgacgccgaacgggtaacggtcctcggttcttagatagtaaacttgaacaggtgagtggacacgaccaacgagtacggaaacgggggacggactaccgtaatcgtccttcgtacgacggcctacgagtccgtcggtcgggcgtacgacggccgtcccgtccctcgtaactcctaacttcctacccgtacggtccctaccgtacgtaccgtaggaaggtacgtcggacggtacgtacgtaactttagttagttacgtacgtacggtacgggtcggggtactacggtaggtacgttacgttacgggtacgggttacgggttaccgggacggggtaacgggtaaccggttaacgggttaccgggtaccggttaccgggtacgggtacccgaaccgggtacccgaacgggtcccgtaccccggtcccccgggttcggttaccccg

SEQ ID NO: 213494 - DNA, 788 bp, Homo sapiens
  misc_feature: GYAE6OF01C0VYE.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatccgccctctgtctctcgccctcccgtgggacgcctcggtcaagcctcacctgcactctgagcagtacgaacacactccacctacgccatcgacagtcggcatcagacaacgacgaccgaacgggtaacggtcccgttcgggtttacgttacggaacgttacgtaaaacgtttcgaacgtaggttaggaagtcggaccgaacgacccaacgtaacggtaccgggaaacggggggaaccggtaacgttaaccccgtaaagtccgtacgttaccgtacggtacggtaccgtaccgaacggtccgttacgggtcggggtaccttacgggaaccggtcccggtaccccttacccgtacgtaaacgttccctaaaccgttcccgtaacccgaacccgttccccgtaacgttaccggttccggtagggaacggtacgttacggaacggttccgtaagttaaccgtttaatttacggttcggaaccggtacggtacggggtacgggtactacggtaggtacctaaggtttcggaggggtttccggtacggggaaccgggtacggtaaccggttacgggttccgggtacccggttccgggtacgggtacccgaaccgggtacccgaagggttccccccgg

SEQ ID NO: 213495 - DNA, 673 bp, Homo sapiens
  misc_feature: GYAE6OF01DVAN6.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctcccgtgggacgcctcggtcaagctcacctgcactctgagcagtgaacacatccacctacgccatcgcagtggcatcagacaacacgaccgaacgggaacgggtcctcggttcttagaatacgtaaacttgacgagtgagtggacacgaccacgacgtacgggaacgggggacggtacctacccgtaagtccgtaccttcgtacgacggtcctaccgacggtccgttcgggtcggggcctcgggaccggtcccggtacccttcccgtacgtacctaccgtaaccttcccgtcccgaccgtccccgttaccgtacgttccgtagggaacggtacgtacggacggttactacgtaactttaagtttacgtcggtacggaacggtacgggtacgggacgtcgtaggtacgtagttcggtagggttcgggttacgggaggggtacggtacgtaacggttcggacccggttcggtacgggtaccgacggcccgtaggtccccgg

SEQ ID NO: 213496 - DNA, 792 bp, Homo sapiens
  misc_feature: GYAE6OF01A23T2.34.59.F04.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
tcagtacacgtgatcacgaccggtgctcgatttagtacacacacttagggattggagtctgcaccatggcttggaccccactcctcttcctcaccctcctcctccactgcacaggtctctctcccagcctgtgctgactcaatcgccctctgtctctgcctccctgggagcctcggtcaagctcacctgcactctgagcagtgaacncatcacctacgccatcgcatggcatcagcaacngccacggaaggtcctcggttctgatgaaacttgacgtagtgatcggactaggccacgagtacggaagggggaccgggtataccccgttaagtccgtaccgttccgtacgtaacgggtcccttacccggaggtcccgttcggtacggggggtccttacgggaccggtcccggtcccttcccccgtacgtacgtttacccgaacttccccggttaccaacccggtccccgttacccgtaacggtttccttaacggggaacggtaacggttcggaaacgggttcctttacgggtaacccttttaagtttccgggttacgtaccggtaaacgggttccggggttacgggggacccttaccgggttagggtacctttacggttaaccgggtcggggtacgggtttaccggggacccgggtaaaaggggttacccgtaaacggggttttacccgggtacccggtttcccggggtaacggggttccctaaaccggggtacccccggtaaacggggttccccgttaccccgggtcccccccgggttcggttaacccccgg

SEQ ID NO: 213497 - DNA, 746 bp, Homo sapiens
  misc_feature: GYAE6OF01DWLBU.34.59.F04.1.454.CMB.1.raw
tcagtacacgtgatcacgaccggtgctcgatttagtacacacacttagggattggggtctgcaccatggcttggacccactcctcttcctcaccctcctcctccactgcacagggtctctctcccagcctgtgctgactcaatcgcctctgtctctcgcctccgtgggacgtcctcggtcaacgctcaacctcgctactcgtgacgcagtacgaacacacgtccacctaccgccactcgcacgtcgcatccgagacaaacgcgaccgaacggggtaacggttccttcggtttctaggaacttacgaaacgtttgacgtaggtgtagtcgactagccaacgtagtaacgggaacgggggaccgtactacccgtaagtccgtcttaccgacgcggtctcgacgtctcggtcgggactcgacgtccgccttcctactacgtactactcccgaccgtaaccgtcctcggttaacggtacgtacggggtaacgtaacggagtaccggtacttagttaacgtttaacgttcgtttacgtaccgggtaacgggtaccgggtttacgggaccctacgggttccggaacctttcggttacgggttacgggttacgggtccggggaacgggtaacggggttaaccgttaaccgggttccgggttaaaccgggtcccgttaacggggtcccgtaaccggtacccgggtaacccggtccggtaaccccggtcccgtttaacggtccccgttaacccgg

SEQ ID NO: 213498 - DNA, 607 bp, Homo sapiens
  misc_feature: GYAE6OF01D543A.34.59.F04.1.454.CMB.1.raw
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgccctcccgtgggacgcctcggtcaagctcacctgcactctgagcagtgaacacatcaacctacgccatcgcatggcatcagcaacgacgaccgaacgggaaggtccgtcggttacttagatacgaaacttgacgtagtgagtggcacgtccaacgatacggaagggggaccggactaccgtaatcgtcttacgcgacggctcgagtcgtcgtgggctggacgccgtctccctcgactcgactcctacacgtcccgttccacgtcgtggaaggtatcggacgtctacgtacttaagtttcgttgtaccgaaggtcggggtcgggcctaacgggtgtaccttagtccggtagggttcggtccgggacggggacggaaccgttagggttcggacccggtcgtcggggtaccacgggacccgtacggcctcccggcccccgttggctacccg

SEQ ID NO: 213499 - DNA, 668 bp, Homo sapiens
  misc_feature: GYAE6OF01BO6Y2.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtacgaacacactccacctaccgccatccgcatggcatcagcaacgagcccgaacgggtaacgggtccttcggttcttagagtacgtaaacgttgaacgtaggtagagtcggacacgccacgacgtacggaacggggggtacggtacttaccctaagtcgtcgtttcacgacgggtcctaccgacgtcgtcggtcggggctacggacggtccgtccttacccgtactaacgttcctaaccttccgtaccccgacgtcccgttacgtacggttcgtagggtaacgtacgtcgggaacggtctacggtactttaagttttacgtcggtacgacgggtaccgggtgggacctacggtggtactagtacggtacgggtcggttaccgggacggtaacggtacccgtaagttccggaccggttgtaccgggacacccggtaccgaacggtcccgtccgtccccgtcggtacc

SEQ ID NO: 213500 - DNA, 567 bp, Homo sapiens
  misc_feature: GYAE6OF01BJAEL.34.59.F04.1.454.CMB.1.raw
tcagtacacgtgatcacgaccggtgctcgatttagtacacacacttagggattgggggagctctgggggagtctgcaccatggcttggaccccactcctcttcctcaccctcctcctccactgcacagggtctctctcccagcctgtgctgactcaatcgccctctgtctctgcctccctggggagcctcggtcaagctcacctgcactctgagcagtgaacacatccacctacgccatcgcatggcatcagcaacagccacggaaggtcctcggttcttgatagaaacttgacagtgatggcagccaacatacggaagggggacggataccctaagtcgcttctcgaggctccagtctcgtggggctggacgcgcctccctcatcactcctccacgtccctccgacgtccgtaggacggtacgtggacggtctacgtaacttagtttaagttcgtacgtaggtaacgggttggggctacgtggacttagttcgagggttcggttcgggacgggacgggtaccaaggttcggacccggtcgtacgggacacggcccgaaggtccccg

SEQ ID NO: 213501 - DNA, 908 bp, Homo sapiens
  misc_feature: GYAE6OF01C42ZA.34.59.F04.1.454.CMB.1.raw
  modified_base (172)..(172): a, c, t, g, unknown or other
  misc_feature (172)..(172): n is a, c, g, or t
tcagtacacgtgatcacgaccggtgctcgatttagtacacacacttagggattggggtctgcaccatggcttggaccccactcctcttcctcaccctcctcctccactgcacagggtctctctccagcctgtgctgactcaatccgccctctgtctctcgcctccgtgggcncctcggtcaagtctcacctgccacttcgtgagcaggtagaaaccacactcccaaccctacgccctaagtccgacagtcggcctaatccgaagaccaaacgacgacccggtaaaccggggtaaccggggtttcccgtttccgggtttacctttaggaaacgtttaacggtaaaaccgtttacggaaaccgtagggtttaggacggttacgggaaccgaacggacccccgtaaacgtaacgggttaacccggggggaaaaacggggggggtaaccccgggtaacctttaaccccccggttaaaggtccccggttaaccgtttccgtaccggaacccggttccccgtaacccgaccgggttcccgtttacggggttccgggggtaccttagggaccccggtcccggttaccccgttcccctacggtaacttcccgttaaccttccccgtacccgtacccgttaccccgtcccggttaacggttaccgtaagggtaacgggtacggttacgggtacggtcccgttaacgtttaacgtttagttttacgtacggttacgtagggtccgggtacgggtaccgtacggtcggttcgttacggttacggtacgggttacgggtaccgggtacgggaacgggtaaccggtacgggttccggtacccggtttccgggaccggtaccgtaccggtcccgtaacgggtccccgttacccgggtccccggtccgttacccgttccccgg

SEQ ID NO: 213502 - DNA, 826 bp, Homo sapiens
  misc_feature: GYAE6OF01CMDKE.34.59.F04.1.454.CMB.1.raw
  modified_base (166)..(166): a, c, t, g, unknown or other
  misc_feature (166)..(166): n is a, c, g, or t
  modified_base (190)..(190): a, c, t, g, unknown or other
  misc_feature (190)..(190): n is a, c, g, or t
tcagtacacgtgatcacgaccggtgctcgatttagtacacacacttagggattgggggagctctggggagtctgcaccatggcttggaccccactcctcttcctcaccctcctcctccactgcacgagggtctctctcccagcctgtgctgactcaatccgccctntcgtctctcgccctccgtgggacnccgtggtacaagcctcactgctactcgtagacgtacagtacgaaaccacactccaaccgtacgaccctaagtcggacctagttacggactaataccgaacgaccaaacgaaccggaccggtaacggggtaacgggttccttacgggttactacggaacgttaaccggtaaaacgtttcggaacgtaggtcgtaacggtacgggaccaaccgtacctaaccgtaacgtaacggtaaaacggggttgggggaaaccgggtaccttaccccgtaaaggtccggttacctttacgacggacgtcctaaccggtacgttcgtcgggtacggcgtacgggccggtccgtacccgttcctaacaacgtcctacgttcccgacgaaccgtcccgtacgtacggttacgaacgggtacggacgtacgggacggttacgttaacggttaacttaacggtttacggtaaccgggttacgggaacgggtttcgggggtacggggaaccttcgggtaccgttacggttcggtttaacggggcgggttttaccgggaacccggggtagggtaaccggttaccgggtaaacgttcccggggaaccggtttcgggtacccgggtaccaaacccgggtttcccggtaaaccgg

SEQ ID NO: 213503 - DNA, 943 bp, Homo sapiens
  misc_feature: GYAE6OF01D721J.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatccgccctctgtctctcgcctcccgtgggacgcctcggtcaagcctccacctgccactctgagcagtacgaacacactccacctaccgccatccgcagtcggacctatccgaacggaccaaaccgacggacccggtaaccggggtaacgggttccctttacggggtttaccttacggaacgttaacggtaaaaccgtttggaaccgtagggttaggaaggttccgggacccgtaacggacccctaacgtaagggttaccggggaaaaccggggggggtaccgggtaaccttaaccccggttaaacggttccccggtaccgtttaccgtacccgggtaacggttccccgtacccgtaaggtcccgggtttaccgggttccggggggaccttaacgggcccggtccccggttacccctttaccccggttactaaccgttacccctacgtttccccccgtaaccggtaccccgttcccccctttaacggtacgggtaccggttaacgggggaaaccgtaggttaccggggtaaaccggttcccgtaagtttaaaccgtttaagtttttaacgtacgggttacccggaagggttaacccgggggttccgggaccgtttaacgggttccggtaaccttaggggttaccggttacgggggttaaccggggttccgggggaacccggggtaaacggttaaccggttacgggtttacccgaccccgggttcgggtaccgggtaccccgaaccgggaccccggttaacgggtcccccgtacccccgggttccctccggggtttaccccg

SEQ ID NO: 213504 - DNA, 643 bp, Homo sapiens
  misc_feature: GYAE6OF01B39A6.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacaggtctctctcccagcctgtgctgactcaatcgccctctgtctctgcctcccgtgggacgcctcggtcaagctcacctgcactctgagcagtgaacacatcacctacgccatcgcagtggcatcagacaacacgccgaacgggaacggtcctcggttctagatagaaacttgacagtgagtggcacgccaacagtacggaaagggggacggtactacctaagtcgtcttctacgacgtctccagtcgtcggtcggggctggacgtccgccttcccgtacacgtccattcccgtaccgacgtcccgttacccaaggttccgtagggaacgggtacttcgggaacggtcctttaacggtaacttttaacgtttagtttcgaacgtagggtaacgggttcggggactaacggttcgggacttagttcggagggttcggttacgggacggtaacgggtaccgttaagggttccgaacccgggttcgtacgggtccaaccggtcccgaacggtccgtcccgtccccgtgggtaccc

SEQ ID NO: 213505 - DNA, 785 bp, Homo sapiens
  misc_feature: GYAE6OF01CRHW5.34.59.F04.1.454.CMB.1.raw
  modified_base (157)..(157): a, c, t, g, unknown or other
  misc_feature (157)..(157): n is a, c, g, or t
  modified_base (182)..(182): a, c, t, g, unknown or other
  misc_feature (182)..(182): n is a, c, g, or t
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
tcagtacacgtgatcacgaccggtgctcgatttagtacacacacttagggattggagtctgcaccatggcttcggaccccactcctcttcctccacccctcctcctccactgcacgagggtctctcctcccagcctgtgctgactcaatccgccctntcgtctctcgcccgtccgtgggacnccgtcggtacaacgcctccacctgcctactcgnggacgcaggtacaacacactaccgaaccgtaccgacctanccgacaggcggacacgtacacgaccaaacgacggaccggtaacgggtaaccggttccgttacggttcgtagagtaacgtaaacttgaacgtagtagagtcgacgacgacaacgtacggacgggaaacggggaccgtactaccgtacgtccgtactacgcggacgcctacggacgcgtccggggtggctacggccgtcccncgtaccctnaccgtctacggttcccaccgtacgtccctacgtacggttacgtagggaacggtgttacggtaccggtcgttaacttaacgttttacgtttaggaaccggtcggtaaaccgggtcggggttccggaaacctgggttaccggtactttaacggggttccggggttaggggttaccgggggtaccgggtaaaacccgggggtaagtaacccggtttaaaccggggtcccgggtaccggttacccgggtccggggaacccacccggggtaacccgtttaccgggcccccgtttacccccggtaaccccgggttcgtttacccccg

SEQ ID NO: 213506 - DNA, 936 bp, Homo sapiens
  misc_feature: GYAE6OF01B1E0I.34.59.F04.1.454.CMB.1.raw
  modified_base (129)..(129): a, c, t, g, unknown or other
  misc_feature (129)..(129): n is a, c, g, or t
  modified_base (155)..(155): a, c, t, g, unknown or other
  misc_feature (155)..(155): n is a, c, g, or t
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
tcagtacacgtgatcacgaccggtgctcgatttagtacacacacttagggattggagtctgcaccatggcttggaccccactcctcttcctcaccctcctcctccactgcacgagggtctctcctcccngcctgtgctgactcaatccgcccttntcgtctctcgcccttccgtgggcgcccgtcggtacaacgccttaccgacctgccacttcagagcaaggtacaaacactataccaaccgtaacnccatccggcagtcggacaancgaacgaccaaaacgcggaccgaacggggtaacggtttccgttcgggtttacttagacgttaacggtaaaactttcgggaaacgtagtaggtaacgacggaccaacgtaaccgaagtaaccggtaagggggaaaccggggggaccggtaccttaacccgttaacgttccgtccgttaccgaacgtacggacccttaccggacggtcgtacggggtcggggtaaccacgggaccggtcccgttaaccctccccttaagtaaccgtcccttaaccgttaccctaccccggtaaccgttaccccttacggaaccgtttaccggtaaggtaagggtaccggttagggaaacggtttccgtaaagttttaaaccggtttaacgttttaaggtaccgggttaacggtaaacgggggttaccggggtacggggtaaccttacgggtaaccggttcggtttaaaccggtttacggggttaaccggggttttaaccggggggtaaccggggttaaaccgggggttaaacccgggtaaaccggttttaaccggggtaccccgggttaccccggggtttacggggtaacccgggtaccgggaaccccggggtaaccccggtttaaccgggggtacccctaacccccggggtttcccccgggtacgggttaaacccccgg

SEQ ID NO: 213507 - DNA, 924 bp, Homo sapiens
  misc_feature: GYAE6OF01EKWOA.34.59.F04.1.454.CMB.1.raw
  modified_base (151)..(151): a, c, t, g, unknown or other
  misc_feature (151)..(151): n is a, c, g, or t
  modified_base (174)..(174): a, c, t, g, unknown or other
  misc_feature (174)..(174): n is a, c, g, or t
  modified_base (246)..(246): a, c, t, g, unknown or other
  misc_feature (246)..(246): n is a, c, g, or t
tcagtacacgtgatcacgaccggtgctcgatttagtacacacacttagggattggagtctgcaccatggcttggaccccactcctcttcctcaccctcctcctcactgcacagggtctctctcccagcctgtgctgactcaatccgccctntgtctctcgccctccgtgggacnccgtcggtacaagcctcacctgccactctgagctagtacgaacacactccaaccttacggcctacgtccganagtggccactacgacggaccaacgacggcccgtaacgggtaacgggttccttcggttcttaggtaacgttacgtaaaacgttgaacgtaggtgtaaggtccggacgacgtacccaacgtacggtaaccgggaacgggggtaccgtaccttacccggtaacgttccggtacctttaccgtaccggtacggtaccctacccggtaacggtccgtttaccggggtgggtacccgtacggaaacccggtccccggttaccggttaccccctaacgtaaccggtttacccaaaccgtttcccccgtaccggtacccggttacccctttaacccgggtacggttttaaccgaacgggggttaaccgtacggttaccgggttaaccggttacccggttaaggttaaccctttttaaggtttaccggttttacccgggaacgggttaaccggggtaccgggggttaccggggttaccctaaccgggttttcggggttaacgttaaaccggttttccggggaaggggttttccggggttaaacccgggggtcgggggtaaaacccggtaaccggttttacgggttacccgggacccgggttttcggtacccggggttaacccgaacggttaccccgggaaacggggttcccctttaccccggggccccgtttaaacggggttccccc

SEQ ID NO: 213508 - DNA, 704 bp, Homo sapiens
  misc_feature: GYAE6OF01C4JM8.34.59.F04.1.454.CMB.1.raw
  modified_base (112)..(112): a, c, t, g, unknown or other
  misc_feature (112)..(112): n is a, c, g, or t
  modified_base (174)..(174): a, c, t, g, unknown or other
  misc_feature (174)..(174): n is a, c, g, or t
  modified_base (253)..(253): a, c, t, g, unknown or other
  misc_feature (253)..(253): n is a, c, g, or t
tcagtacacgtgatcacgaccggtgctcgatttagtacacacacttagggattggagtctgcaccatggcttggaccccactcctcttcctcacctcctcctccactgcacnggtctctctcccagcctgtgctgactcaatcgccctctgtctctcgccctcccgtggggacncccttcggtcaacgcttcacctgccactcgtagagcagtagaacacattccacctacgcccatcgcagtcggcatcganacaacacgaccgaacgggaacggttcctcggtttcttagaattagaaaccttgaactacggtgaactggccacgaccaacgagtaccgggaaagggggacggtactacccgtaacgccggtactttctacgacggtctacccaggtccgtcggtgggtcctgggaacgtccccgtcctcccgtactacctacgttacctaccctccgaacgcccccttacgtacggttcctagggtaacggtagtcgggtagggacccttaggtaaccttttagtttaagttaccgtaacggtacgttaacggggttcgggaacctgggtcgtaacccttggtttacggaacgggtttcggtacggggaccggtaaggtaacccgtaacggttcggtaaccccggtcgttaccgggacctaccggtaaccggacgtccgaccccgtcccgttcggtacccg

SEQ ID NO: 213509 - DNA, 634 bp, Homo sapiens
  misc_feature: GYAE6OF01EHETP.34.59.F04.1.454.CMB.1.raw
  modified_base (207)..(207): a, c, t, g, unknown or other
  misc_feature (207)..(207): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatccgcctctgtctctgcctccctgggagcctcggtcaagcctcgacctgcactctgagcaggtnaacacactccacctacgccatcgacatggcatcagacaacgagccgaagggaacggttccttcggttcttgatagtaactagacagtagatcggacacggccacagtacggaaggggacgtatacccgtaatcgtctcgtacgacggtctcgacgtcgtcggtggggtctcgacggcgtccgtcccgtctacgtactacgtaccctacccgacgttcccgaccgttcgtcgtacggacgggtactagggtaacggtccttacgtaactttaggtttcgtacggttacgacgggtaacgggttcgggactacggttggcttacgttcggtacggttggtccgggacgggtacggaacgtacggttccggtacggtccggtaggcccgacgtacccggagtcccgtccgtcccgttggcccttacccgg

SEQ ID NO: 213510 - DNA, 762 bp, Homo sapiens
  misc_feature: GYAE6OF01ES0G4.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgccctcccgtgggacgcctcggtcaagcctcacctgccactctgagcagtgaacacatccacctaccgccatcgcagtcggcatcagacaacacgaccgaacgggaacgggttcccttcggggtttcttaggaattagtaaaaccgtttggaaccgtaggtgtaagtgggacacgccacagtacggaaggggggacggactcccgtaagtccgtctttaccgaccgacggtcctacccgacgtccgtaccgggtcgggggtacttcgggaaccggtcccggtcccttcccccttactaccgttacctaacgttcccctacccgtaccgtcccgttacccgaacggttccgtaggtaaggggtctacgggtacgggtcctttaacggtaacttagtttttaagttcggaccgtaacgggtaccgggttacgggggtcctaaccggttcgggtacgtacgtttcggtaggggttcggttaccggggaccgggtaaggggtaacccgttaagggttccggtacccccgggtgttacccggggtaccgtaaccgggacccccggtaagggtcccctttacccccgggccccccggtcgggttaccccg

SEQ ID NO: 213511 - DNA, 732 bp, Homo sapiens
  misc_feature: GYAE6OF01BECYY.34.59.F04.1.454.CMB.1.raw
  modified_base (165)..(165): a, c, t, g, unknown or other
  misc_feature (165)..(165): n is a, c, g, or t
  modified_base (219)..(219): a, c, t, g, unknown or other
  misc_feature (219)..(219): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatccgccctntgtctctgccctccctgggagcctcggtcaagctcacctgcactctgagcagtnaacacatcacctacgcatcgcatggcatcagaccaacagccgaggaacggtccttcggttctgatagaaacttgacagtgatggcagccagacgtacggaagggggaccgacttacccgtaatccgtcttacacgtacggcctaccgagtccgtacggtgggggtaccttggacgtccgtcccttcccgttacgacgttaccacttcccgtaccctacgtcccctaccgtacgttccgttagggacggtaacgtcgggtaacgggtaccctttaagggtaaccttttaagtttttaacggtttacgggttaaccgggtaaccgggttaccggggttacggggtaccgtaaccggtttcggaaccgtttacgttttaccgggacggggtttccgggtttaaccgggggcggggtaaacgggggtacccgttaaacggggtttaccccggtaaccccggtttccgggttacgggggttaaccccaccggggttcccccggaaaggggttcccccg

SEQ ID NO: 213512 - DNA, 761 bp, Homo sapiens
  misc_feature: GYAE6OF01C1G12.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatccgccctctgtctctcgccctccgtgggacgccttccggtacaacgcctccaccgtgcctactcgtagacgcagtagaaccacactccacctacgccactccgacagtggccagtaccacgccaacgacgaccgacgggtacggttccttggttctgatacgtaactgaactggtagtgtacggcacgaccgagtaacgtacgggaacgggggtaccgtacttacccgtaagtcgtccttacgtaccgacggtaccctccgtacgtcccgttacgggtcggggtaccacgggacgtcccgtcccgtaccgtctacgtcctaccttcccgcccctacgtccctacgtacggttcgtaacggacggttacgtacggtacggtacctttacgttaacgtttaacgtttagttaccgtacggtaacggggtaacggggtccgggtacctacggttagggttacccttagggtttcgggtaacggggtttacccgggtaccggggtacgggaaccgggtttaacgtaccgggtttaccggcccggttaccgggttacgggaaccccggcggtaaccccggttacgggaccccgtttacccggtccccccgggtcgttacccg

SEQ ID NO: 213513 - DNA, 640 bp, Homo sapiens
  misc_feature: GYAE6OF01EMCUZ.34.59.F04.1.454.CMB.1.raw
  modified_base (163)..(163): a, c, t, g, unknown or other
  misc_feature (163)..(163): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgcctntgtctctgccctcctgggacgcctcggtcaagctcacctgcactctgagcagtgaacacatccacctacgccatccgcatggcatcagcaacagccaggaacggtcctggttcttgatagaaacttgacagtgatggacagccanagtacggaagggggaccgtatacccgtaagtcgtcttacncgaggcctcgacgtcgtccggtgggcctaggacgtccgtccgtccctacacgtcaacttccgtacccgaacgtccctacccgtaacggttctagggaacgtagtacggaacggtccgttagtaacttaagttttacggttcgtacggtaacggtacgggttacggggacctacggtcggtacgtacgtttacggtagggttcggttaccggggacggggtaacggtaccgtaacggttaccggtaacccggttccggtacgggtaccgaacggtcccgtaaacgggtccccg

SEQ ID NO: 213514 - DNA, 571 bp, Homo sapiens
  misc_feature: GYAE6OF01BBJ9R.34.59.F04.1.454.CMB.1.raw
  modified_base (547)..(547): a, c, t, g, unknown or other
  misc_feature (547)..(547): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagaccacggaagggtcctcggttctgatgaaacttgacaggtgagtggcagccacagtacggaaagggggacgggactacccgtaaatcgccttctcgaggtcctccagcgtcgtggggctgacgcgcctccctcacttcactcctccacgtccctcagtcgtaggaggatggacgctgacttagtttagtgtcgaagtccggtgggacctagtggactagttcgagggttggttacgggacggaaggggtacccgtaagggttcggacccggttccgtagggtccgacggtacccgacgggtcccncccggtccccccgtggttaccccg

SEQ ID NO: 213515 - DNA, 786 bp, Homo sapiens
  misc_feature: GYAE6OF01D4XT7.34.59.F04.1.454.CMB.1.raw
  modified_base (168)..(168): a, c, t, g, unknown or other
  misc_feature (168)..(168): n is a, c, g, or t
  modified_base (501)..(501): a, c, t, g, unknown or other
  misc_feature (501)..(501): n is a, c, g, or t
tcagtacacgtgatcacgaccggtgctcgatttagtacacacacttagggattgggggagctctggggagtctgcaccatggcttggaccccactcctcttccctcacccctcctcctccactgcacagggtctctctcccagcctgtgctgactcaatccgcccttntgtcctctcgccctcccgtgggacgtcccgtcggttaccaacgtcctaccacctggcctacttcgtgacgactaagtacgaaaccactaacttcccaaccctaccgacctagtccgactaagttggactaactacgacgaaccaaaccgaccgaccggaaacggggtacgggtcccgttacggtttccgtagtaacgttacgtaaaacgttcgaacgtaggtagtaacgttcggacctacgacccgaaacgtacggtaaccggggaaccgggggtaaccgtaccgttaacctacgttacgtcgttacctacggcgtcctcgacgtcgtacggngggctagacggtcctccctaccgtagtactaccgtacttccccgtccgaacgtcccgttaaccggtagttccggtaacgggaacggtacttaacggggacgttcttaacgtacgtttaagtttacggtacgtcggaaggttccgggtacgggactacggtcgtacgttaacggttcggaacggggttttcggggaccggacgggggtaacgttaaaccgtacggggttcccgtaacccgggtcgggttacggtaacccgacccggtcgggtacccggtccccggg

SEQ ID NO: 213516 - DNA, 728 bp, Homo sapiens
  misc_feature: GYAE6OF01BLYY7.34.59.F04.1.454.CMB.1.raw
  modified_base (152)..(152): a, c, t, g, unknown or other
  misc_feature (152)..(152): n is a, c, g, or t
  modified_base (350)..(350): a, c, t, g, unknown or other
  misc_feature (350)..(350): n is a, c, g, or t
  modified_base (475)..(475): a, c, t, g, unknown or other
  misc_feature (475)..(475): n is a, c, g, or t
  modified_base (534)..(534): a, c, t, g, unknown or other
  misc_feature (534)..(534): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatccgccctntgtctctcgcctcccgtgggacgcctcggtacaacgcctccacctgacctactctgacgcagtacgaacactactccaacctacgaccctatccggacagtcggacacgcagaccaaacgaccgccggtaaccggggtacggttcccgttcggttacgttagaagttaacgtaaacttggaacaggtaggatggccanaccagtacggagggaacggggacgtaccgttacccttaagtccgtccgttacaccgtacgcctcgtacgcgttcgggtaggcttaggcctccgtcccctcgtacagtcctatccccgtacgtccnccctacgttcgcgtggtaacgtcgtaggggtactcggttactaacgtagtttttaacgngttaaccgggaagggtttccgggaacggtctaacggttaccggtcgttaacttcgggggtacgttcgggggttacggccgggtaaaccgggttaaactcggggttaacctcccgggtgggttacccgggcttaaccccggggaccgttacccgggaccgttcccccggtaacccgtcccgtttagccccccggg

SEQ ID NO: 213517 - DNA, 710 bp, Homo sapiens
  misc_feature: GYAE6OF01DCSOW.34.59.F04.1.454.CMB.1.raw
  modified_base (166)..(166): a, c, t, g, unknown or other
  misc_feature (166)..(166): n is a, c, g, or t
  modified_base (459)..(459): a, c, t, g, unknown or other
  misc_feature (459)..(459): n is a, c, g, or t
  modified_base (625)..(625): a, c, t, g, unknown or other
  misc_feature (625)..(625): n is a, c, g, or t
tcagtacacgtgatcacgaccggtgctcgatttagtacacacacttagggattgggggagctctggggagttctgcaccatggccttggaccccactcctcttcctcaccctcctcctccactgcacagggtctctctcccagcctgtgctgactcaatcgccctntgtctctgcctcccgtgggacgcctcggtcaacgctcacctgcactctgagcagtacgaacacatcacctacgccatcgcagtggcaatcaagccaacgcgaccgacgggtaacggttcctacgggttcttaggactaggtaaacttcgacgtagtagagtcggcacgccaacgtagacgggaaacgggggcggtacttacccgtaattccgtactttcgacgaacggtccctaccgtaggtccgttcggtacgggggtacttcgggtaaccggcccgtacccttaccccgtntaaccgtcaacgttcccctaccgaccgtcctccgaacggttcagggacgtcgtacgggacgtccgttaagtacttcggtttacgttcgaacgggaggttaccgggggtcggtaccctacggttacggtacttacgggttacggttcgggttcgggttacccggggngggtttaaccggtaacccgtaacggttttccgggccccgttacggggtaccggtacgaaacccgtcccgttaaccgggtaccccg

SEQ ID NO: 213518 - DNA, 667 bp, Homo sapiens
  misc_feature: GYAE6OF01B0OKJ.34.59.F04.1.454.CMB.1.raw
  modified_base (342)..(342): a, c, t, g, unknown or other
  misc_feature (342)..(342): n is a, c, g, or t
  modified_base (398)..(398): a, c, t, g, unknown or other
  misc_feature (398)..(398): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcagtggcatcagacaaacagcccgaacgggaacgggtcctcggttcttgatagtaaacttgacagtgatggcacgccacaagtacggaagggggacggactcccgtaatccgcttcncgaggcctcgagtcctcggtggggctggacgccgtcctcccgtcactccacttccncccgacgtcccctaccgtaacggtcgtacgggtaggacttagggacggtctacggtaactttagtttagttcgtacggacggtacggggtcgggaccgtacggtcggtacttaggtttaccggtaggggttaccgggttccggggacggggtaacggggtaacccgttaagggtttaccgggtaccccgggttccggtacggggttacccgaaccgggtacccgaaccgggttcccgtaccccggtcccccccggttcgggttaacccc

SEQ ID NO: 213519 - DNA, 847 bp, Homo sapiens
  misc_feature: GYAE6OF01BHLKR.34.59.F04.1.454.CMB.1.raw
  modified_base (150)..(150): a, c, t, g, unknown or other
  misc_feature (150)..(150): n is a, c, g, or t
tcagtacacgtgatcacgaccggtgctcgatttagtacacacacttagggattgggggtctgcaccatggcttggaccccactcctcttcctcaccctcctcctccactgcacagggtctctctccagcctgtgctgactcaatcgcctntgtctctcgccctccgtgggacgtccgtcggtcaacgcctccaccgtgccacttctaggacgtcgaagtacgaaacacactcctaacccgtaccgacctactccggacgtaagttcgggacctaacgtacgaacggaaccaaaaccgacggaacccgggtaacgggggtaaaccggggttccccggttaccgggtttacgtttacggtaaagttaaccgttaaaccgtttacggaacggttaggtacggtaagtcgggacgaaccggacccgtaacgtaagggaaccgggggtaaagggggggtacccggtaaccgttaaccccgttaacggttccgtaccgtttccgaaccgtacggtccctacgcgtacgttcgggtcgggtcgtacggaccgcccgtcctccctcgtactaccgtacctccctaccgacggtacccctgtaacccggtgtaacggaagtcggtaggaccggtcttacgttaacgttacgtttagtacgttacggaccgggtagggttcggtacgcggtttacgggctttaggtccgggttagggtaccgggttaccggggaaccggggttacggaaccgtttacgggtcccgggtacggtttaccgtagggggtaccccagggttacccgggaaccgggttcccccggacccggtttccccccgttggtcccctttaccccggg

SEQ ID NO: 213520 - DNA, 614 bp, Homo sapiens
  misc_feature: GYAE6OF01BI754.34.59.F04.1.454.CMB.1.raw
  modified_base (152)..(152): a, c, t, g, unknown or other
  misc_feature (152)..(152): n is a, c, g, or t
  modified_base (174)..(174): a, c, t, g, unknown or other
  misc_feature (174)..(174): n is a, c, g, or t
  modified_base (233)..(233): a, c, t, g, unknown or other
  misc_feature (233)..(233): n is a, c, g, or t
  modified_base (514)..(514): a, c, t, g, unknown or other
  misc_feature (514)..(514): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatccgccctntgtctctgccctccgtgggacncctcggtcaagctcacctgcactctgagcagtgaacacactccaccgtacgccagtcgnatggcatcagacaacgacgaccgaacgggtaacggttccttcggttcttagacgtacgtaaccgttgacgtaggtagacgtcggacacgacctagaacggtacgggaaacgggggacggtacctacccgttaagtccgtcttacgtcgacgtcctaccgcgtcgtcggtggctcggacgtcgtccctcccgtatacctcgtactcctaccgtaccggtccttacgtacgtcgtaggagtactcggacggtctacgttacttagttatcgtacgaggtcggnggactacgtgactagtcgagggttcgcgggacggtacgacgttcggttaccgcggtcgtacggcgacggaccgtacggtcccgtccgtcccggtctaccg

SEQ ID NO: 213521 - DNA, 756 bp, Homo sapiens
  misc_feature: GYAE6OF01C9TCP.34.59.F04.1.454.CMB.1.raw
  modified_base (175)..(175): a, c, t, g, unknown or other
  misc_feature (175)..(175): n is a, c, g, or t
tcagtacacgtgatcacgaccggtgctcgatttagtacacacacttagggattggggtctgcaccatggcttggaccccactcctcttcctcaccctcctcctccactgcacagggtctctctccagcctgtgctgactcaatccgccctctgtctctcgccctccgtggggacnccttcggtacaacgtcctcctacctgacctactctacgagcagtacgaaacacactccaaccgtaccgcctagtcgacaagtcggactacgtcaacgaccaacgacggtaccggaacgggtaaccgggttccgtttacggttacgttacgaacgtaacgtaaacgttcgaacgtaggttacgagtcggacgtacgaccgaacgtacggtaccgggaaagggggtacccgtacttaacccgtacgtaccgtccgttacctacggtaccgcctacgacgtaccgttcgggacgggtcgtacggacgtccgtcctaccgtactactactaccttccgtacccgaccgttaccgtacgtaccgtttcgaaggtacggttacggtacggtacggttactaacggttactttacgttaggtacctaacgggtaacgggtcgggtacggtacgttacggtcgttaacgtacggttaccggtgggtaccgggtaccgggaacgggtcgtaccggtaagtttccgggacgtttcgggtcgacccgacgtaccggttcggaccccgtaccggtacctcgggtccttaccgg

SEQ ID NO: 213522 - DNA, 874 bp, Homo sapiens
  misc_feature: GYAE6OF01CD08H.34.59.F04.1.454.CMB.1.raw
  modified_base (173)..(173): a, c, t, g, unknown or other
  misc_feature (173)..(173): n is a, c, g, or t
tcagtacacgtgatcacgaccggtgctcgatttagtacacacacttagggatggggggagctctggggagtctgcaccatggcttcggaccccactcctcttcctcacccctcctcctccactgcctacagggtctctctacccagcctggtcgctgacctcaatccgccctntcgtcctacgtccgcctaccggtgggaccgtccgtacgtcaacggtcctaccgacgtctaccaacttcgtggacgacctagtaaacgaacctacaccttacccgaacccttacccgctaaaccgttcaacgttacgcggacttaccaacggacgaaccaaagtccggaacgggtaaccggtacggggttccgtttaccggttacgtacgtaacgtaaacggttaacgtacggaaccggtaagttaacggtaacgcggtaaaccgaccgtaacccaacggtacccggttaaacggggaaaccggggtaccggtaaccgttaacccgttaacggtaccgtttcccgtaccggtaaccgtacggtaccgtaccggtacctaccggggtccgggtacggttacccgacggttacccgggtccctaccgtaccgtaactccgtaaccttccgacccgttaaccggacccgttacgtaaccctcgggtacgtaacgggtacgtaaacggtcggtaacgtacggtttacgtaactttcgtaagttccggtagggtaccgggttcgggtacgtagttacccgggtagttacggtcttacgggggtacggtaccggggtacgggtaccgggtacggttaaccgggtccgttaaggggtccccgtttaagggacgggtaccccgtagggtaacccgccgggttaaccccgg

SEQ ID NO: 213523 - DNA, 766 bp, Homo sapiens
  misc_feature: GYAE6OF01EUHWS.34.59.F04.1.454.CMB.1.raw
  modified_base (259)..(259): a, c, t, g, unknown or other
  misc_feature (259)..(259): n is a, c, g, or t
  modified_base (473)..(473): a, c, t, g, unknown or other
  misc_feature (473)..(473): n is a, c, g, or t
  modified_base (516)..(516): a, c, t, g, unknown or other
  misc_feature (516)..(516): n is a, c, g, or t
tcagtacacgtgatcacgaccggtgctcgatttagtacacacacttagggattggggtctgcaccatggcttggaccccactcctcttcctcaccctcctcctccactgcacagggtctctcctcccagcctgtgctagactcaactcgccctctgtctctcgcctccgtgggcgcctcggtacaagctcgacctcgctactcgtgacgcaggtacgaaacacactccaaccgtaccgacctatccgcagtcgctaacnccgaacgacaaacgacggaccggaaccggggtaacgggttcccgttcggtttacgttacgaagtttacgtaaaacgttacggaacgttaggtacggtacgttacgggaccaccgtacccgaacgtaaggtaaccgggaaacgggggtaccggtaacctaaccgtaacgtccggtaccttcgtacggaccgtacgtacgtaccgtcgttccgggngggttcacgggccgtaccgtcctccacgtactacctcttaccnccgtacgtccctacccgtaggttacgaagggacgttacggacggtttaaccgggtacttacgggttaacttttaaggtttcgttaacggcggtaacggggtaacggggttccgaccggtagttccggtactccggtttgggtaccggggtcgggtaccggacgggttacggaacgttacggcggttaccggcggtccgtacggtaccgaccggtaccgtaccggcccttaccccggtccggtcctacccg

SEQ ID NO: 213524 - DNA, 829 bp, Homo sapiens
  misc_feature: GYAE6OF01CRY9U.34.59.F04.1.454.CMB.1.raw
  modified_base (132)..(132): a, c, t, g, unknown or other
  misc_feature (132)..(132): n is a, c, g, or t
  modified_base (485)..(485): a, c, t, g, unknown or other
  misc_feature (485)..(485): n is a, c, g, or t
tcagtacacgtgatcacgaccggtgctcgatttagtacacacacttagggagttggagtctgcaccatggcttggaccccactcctcttcctcaccctcctcctcactgcacaggtctatctccagcctgtnctgactcaactccgccctcgtgtcctctcgccctccgtgggactcccgtcgggtcaagtcctccacctgccactccgtagacgcagttacgaacactatccaaccgtccgacctagtccgactaggtcggacctagtacgaacgaaccaaacgaccggaccgtaaaccggggtaacgggtttccccgtaccgggtttacttacggaacttacggtaaaccgttggaaccgtaggtgacggtcggacaccgaccgtaacaggtaaccgggtaagggggaaccgtacctaaccgtagttaccgtctttacgtcgaacggttcccaccgtaggtcccgttcggtacggggttaccnggaaccggtcccgtccccgttacccgtacggtaccttaccgttacccgtaccgttaccccggtacccgtacccgttaacccggtaccgtttacgggttaacggacggttagtcgggtaaaccggttctacggttaacgttttacttacggttacgtaacgggttacgttaccggggtcggtaacgtacgtttacggtacgttaaggttcgggtaaggttcccggggtagggtaaccgggtaacgggtaaccgttaacgggtccgttaaccggttacctacggtaacggttacccgacccggggttacctaaccggttaccccggtccccgttaacccgtcccgg

SEQ ID NO: 213525 - DNA, 1052 bp, Homo sapiens
  misc_feature: GYAE6OF01B5RTU.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatccgccctctgtctctcgcctccgtgggacgccgtcggtcaacgtctcacctgccactcgtgacgcagtacgaacacactccaaccgtacgccagtccgctacgtggaccattaccgacgaccaaaccgacggacccgtaaaccgggggtaacggggttccccgtttccgggtttaccgtttacggtaacgtttacgggttaaaaccgtttacgggaaccgtaaggttacggtaacgttacggggaccgaaccgtacccgaaaccgtaacggtaaccgggaaaacggggggggggtaaccgggttaaccgttaacccccgtttaaacggttacccggtttacccgtttaacccgttacccgggtaaccgggtaccccttacccggtaacgggtcccgtttacccggggttacgggggtacccgtaccggggtaaccgggtacccgggttccccgtttacccccggttactaccggttacccttaacgttacccccgttaaccccggttacccggtaccccttacccggttaacgggttacccggttacgggtaacgggtaaccgggttaaccgggaaccggggttacctttaaccgggtttaaccgtttaagttttaccggtttaacggttacccgggttaaacgggggttaccggggttaccgggggtacccgttaacccggttcgggggttaaacccgtttaacggttttccgggggtaaaccgggggtttccggggtttacccggggggtaacccggggggttaaacccggggtaaaccccggggtttaaggggtttaaccccggggttaccccgggtttaccccgggttacgggggttaaccccgaaccccgggggttaaaccccgtaacccgggggtttaacccccccggg

SEQ ID NO: 213526 - DNA, 831 bp, Homo sapiens
  misc_feature: GYAE6OF01B9OVF.34.59.F04.1.454.CMB.1.raw
tcagtacacgtgatcacgaccggtgctcgatttagtacacacacttagggattggggtctgcaccatggcttggaccccactcctcttcctcaccctcctcctaccactgcacgaggtctctcctccagcctgtgctacgactctaatcccgcccttgtcgttcctctccgtcccgtcccgtaggggactccgttcggacaacgcctaccaccgttcacctctagaggactacgaacgtaacacctaaactcgtaccaacccgtcgacctacgcgactacggtcgaactcgacgacgaaccgaacgaccgacggtaaccgggtaccggttccgttacggttagtcgaagttaacgtaacgtcgacgtagtagtacgtcgacgacacgtacgacggtaacgggaacgggtacgtaccgttaaccgtcgtaccgtaccgttaccgtcggtacgtcccgtacgaccgttccggtttcgggacgtcgtcggtaccgtcccgtccttaccgtacctacctacctccggtcctacccgtaccgtaccgttaagtacgttccgaaggttaccggtcgtacgggttacgtctttaaaacgtccgttttacgttaacggggttgtaaccgggtaacggggttcgttaaaccggggtcctaagggtttccggttaggttacccggtttagggttacccgggttacggggttaccggacgggggttaaacgtaaccggtttaacccgtccgggtttaccgggtaccgggtcgggtaccccgaaccgttccccgggttacggccccggttcccggtacccgttccgtacccgggtttaccccg

SEQ ID NO: 213527 - DNA, 822 bp, Homo sapiens
  misc_feature: GYAE6OF01EF4CR.34.59.F04.1.454.CMB.1.raw
  modified_base (139)..(139): a, c, t, g, unknown or other
  misc_feature (139)..(139): n is a, c, g, or t
  modified_base (172)..(172): a, c, t, g, unknown or other
  misc_feature (172)..(172): n is a, c, g, or t
tcagtacacgtgatcacgaccggtgctcgattttagtacacacacttagggattggggtctgcaccatggcttggacccactcctcttcctcaccctcctcctccatgcacagggtctctctccagcctgtgctgactnaactcgcctgtcgtctctcgcctccgtgggacncctaggtcaaggtcctacgacctgctactcgtgatcgagtcgaacaccgtacttaccaaccgtaccgcctagttccggactacggttggaacctagtccgaacgacctaacggaccgtaccgggtaacgggtaccggttccgttacgttctagtactacgtacgtacgacgtagtgtagtcggacacgtacctacggtacggtaacggggaacgggtacctactaccgtacgtccgttacgtcgtacgacgtccgtacgtcgtcggttcggcggtacgtacggccgtaccgtaccgtacctaacttacgtaccgttaccgttacccgtaccgtaccgttacccttaacgttcgggtaacgtacggtaaccgggttacgacgggttaccttaaccggttaacgtttaggtttacgtttacggtacggtacgggtacggttccggggtacgtaccggtacggttaccggtaacggtttaccgggttcgggtaaccggggttccgggtaaacgggtaccggttaaaccggtaccggtttaccggttacccgggttaacgggttccgggtacccgggttaaccgtaacccgggtacccggtttacccgggtaccccgtaccggggttaccccctttcggtaacccgttcccggg

SEQ ID NO: 213528 - DNA, 495 bp, Homo sapiens
  misc_feature: GYAE6OF02HBF5X.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaagggtcctcggttcttgatgaaacttgacagtgatggcagccacatcaagggggacggatccctaatcgcttctcaggctccagctctggggctgagcgctccctcatcatctccagcctcagtctgagatgaggctgactattatgtcagacgtggggcacgtggctagttcgagggttgttcgggcggtagggacctaaggttcgaccgtccgtgggtcaggcccaggcctcgccccctggtcc

SEQ ID NO: 213529 - DNA, 678 bp, Homo sapiens
  misc_feature: GYAE6OF02JUCL2.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaagggtcctcggttcttgatgaaacttgacagtgatggcagccacatcggaagggggacggatcccgtaaagtccgtcttcctcgaacggtccttaccagtcctacgtgggggccttgggaacgtccgtcctccccgtacgaacttcccaacttcccttaccgaccgtccccgttaccgtacggttcccgtaggacgggaacgttcggacgggtaccttacgggaactttacgtttacgtttacggtaccgaacgggttaccggttcggggggacctacgggtcgggtaccttacgtttccgtaaggggttcggttacgggggtaccgggtaacgggggtaacccgttaagggtttccggtaacccgggttccggtacgggggttacccaaccgggtacccggtaacgggtccccgg

SEQ ID NO: 213530 - DNA, 509 bp, Homo sapiens
  misc_feature: GYAE6OF02HIX22.34.59.F04.1.454.CMB.1.raw
  modified_base (242)..(242): a, c, t, g, unknown or other
  misc_feature (242)..(242): n is a, c, g, or t
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
  modified_base (456)..(456): a, c, t, g, unknown or other
  misc_feature (456)..(456): n is a, c, g, or t
  modified_base (482)..(482): a, c, t, g, unknown or other
  misc_feature (482)..(482): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaaacngccaaggaagggtcctcggttcttgattgaaacttgacagtgatggcagccaactagtcggaaagggggcggatccctaatcgcttcncaggctccagcctcgtggggctgagccgtcctcccnactcatcctccacgccctccagtcctggacggagtgaggtctgtactattntgcaggtacggtgggcacgtgctnttcgaggttgtcggnggaggactagtcgaccgtcgtgggcngcccaggctccggccccttggctaccg

SEQ ID NO: 213531 - DNA, 646 bp, Homo sapiens
  misc_feature: GYAE6OF02H46PH.34.59.F04.1.454.CMB.1.raw
  modified_base (346)..(346): a, c, t, g, unknown or other
  misc_feature (346)..(346): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggagcctcggtcaagcctcacctgcactctgagcagtgaacacatcacctacgccatcgcatggcatcagcaacagccacgggaggtcctcggttctgatagaaacttgacagtgatggcagccacagtacggaaggggggacggactcccgtaagtccgtcttcncgaggcctccgagcctcgtgggggctggacgccgtcctccctcacttccacttccctccgacgtccctcgagttccgtaggaggatcgggaggtcctaggtaactttagtttagtttcggtaccgaagggtaccgggttcgggggacctaacggttcgggacttacgttttccgggaggggttttcgggttacccgggggacggggtaaccggggtaaacccgttaagggttcccgggtaccccgggtttacccgggtacggggttacccgaacgggtacccccggtaagggtcccccgg

SEQ ID NO: 213532 - DNA, 556 bp, Homo sapiens
  misc_feature: GYAE6OF02F6805.34.59.F04.1.454.CMB.1.raw
  modified_base (164)..(164): a, c, t, g, unknown or other
  misc_feature (164)..(164): n is a, c, g, or t
  modified_base (185)..(185): a, c, t, g, unknown or other
  misc_feature (185)..(185): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctntgtctctgccctccctgggancctggtcaagctcacctgcactctgagcagtgaacacatcacctacgccatcgcatggcatcagcaacagccacggaggtcctcggttcttgatgaacttgacagtgatggcagccacagtcgaagggggacgggactaccctaagtcgcttctcacggctcagctcgtggggctgacgcgcctccctcatcatcctccacgtccctccagtctggaggatggagctagacttattattgtacaggacggttggggcagtgggctagttcgagggttcggttccggggacgggtaacgggtaaccgtaaaggtttccggtaacccggttccggttcggggtaccgaaccgggtccccgtaagggtcccccg

SEQ ID NO: 213533 - DNA, 627 bp, Homo sapiens
  misc_feature: GYAE6OF02FSDPP.34.59.F04.1.454.CMB.1.raw
  modified_base (249)..(249): a, c, t, g, unknown or other
  misc_feature (249)..(249): n is a, c, g, or t
  modified_base (389)..(389): a, c, t, g, unknown or other
  misc_feature (389)..(389): n is a, c, g, or t
tcagtacacgtgatcacgaccggtgctcgatttagtacacacacttaagggattggaggggtctgcaccatggcttggaccccacgtcctcttcctcaccctcctcctccgactgcacagggtctctctcccagcctgtgctgactcaatcgcctctgtctctgcctccctgggagccctcggtcaagctcaccgtgcacgtctgagcagtgaacacatcacctacgccatcgcatggcatcagcaacngccacggaaggtcctcggttctgaatcgaaacttgactagttgagtgggcaaggccacgactacggaaaggggggtacggattccccgtaatccgcttcgtcacggctccgagctcgtggggcctggagccgactccctnacgtccactcctcccacgtccctacagtctggaggtatggaggtctagtacttattattcgcaggtacggtgggtacagttcggtactagtttcggagggttcggtttaccgggacgggtaacggggaccgttaaaggggttccggtaaccccgggttccggtacgggggttaccctaccgggaccccccggtaaaggggtcccttacccgggtacccccccggttgggttacccccg

SEQ ID NO: 213534 - DNA, 551 bp, Homo sapiens
  misc_feature: GYAE6OF02F56XY.34.59.F04.1.454.CMB.1.raw
  modified_base (324)..(324): a, c, t, g, unknown or other
  misc_feature (324)..(324): n is a, c, g, or t
  modified_base (361)..(361): a, c, t, g, unknown or other
  misc_feature (361)..(361): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgagagcctcggtcaagctcacctgcactctgagcagtgaacacatcacctacgccatcgcatggcatcagcaacagccacggaaggtcctcggttcttgatgaaacttgacagtgatggcagccacatcgaagggggacggatccctaatccgcttcncaggcctccagctcgtggggctggacgcgcctccctnactcatctaccacgtccctccgagttctaggaggtgtggacggtctgtaacttatttagttgtacgaggtccggtggggcctacgtggctattcgagggttcgtcgggacggacgggtaacctaaggttcgaacccggttcgtggggtacacgggaccccgtaaggtcccgttaccggcccccgttcggg

SEQ ID NO: 213535 - DNA, 856 bp, Homo sapiens
  misc_feature: GYAE6OF02GZLH0.34.59.F04.1.454.CMB.1.raw
tcagtacacgtgatcacgaccggtgctcgattttagtacacacactttagggtagttggagtctgcaccactcggcgttggacccctactccgtctttcctctacccgtcctcctccacgtgcacagggtctctctcccagcctgtgctgactcaatcgtccctctgtctcttagcctccctgggagcctcggtcaacgcttcgaccgtgcctacggtctcgaggccgacgggtcgaacacgatccacctaccgccatccgcctagtgggactaagttcgagccaaacgcgacccgaacgggtaacgggtccgttcgggttccttgacgttacgtaaaaccgttggaacgtggttggagttcgggcctacggaccctaagtagtaccggaaagggggaccggtacgttacccgtaagtccgtacctttacgtacgtaacggtcctaccgagtcccgttcggttacgggggtaccgtcgggtaacgcccgtacccgtttccccgtagacttacctaacgttccgtaacccgtaaccgtaccccgttaccgtaacgttaccgttacgggaacggtacgtaacggtacgggtaccgttaacggtaacctttaagtttacgttacggttaccgaacgggtaccgggtacgggggtacccttaacggttacggttaccgtttaaggtttacggtaaacggggttcgggttacgggtaccgggtaacggggtaaacccggttaaccggggtttacccgggtaaccccgggttaccggttaccggggtacccgtaaccggggtaccccgggtaaaccgggtccccgggtaccccggttcccccgggttaccggttacccccgg

SEQ ID NO: 213536 - DNA, 626 bp, Homo sapiens
  misc_feature: GYAE6OF02G2WT6.34.59.F04.1.454.CMB.1.raw
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
  modified_base (389)..(389): a, c, t, g, unknown or other
  misc_feature (389)..(389): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagcaacagccacggaaggtcctcggttctgatgaaacttgacagtgagtggcagccanagtcggaaagggggacggactacccgtaatccgtcttctcgacggcctccgagtctcggtggggctggacgccgtcctccctnactccacttcccnccgacgtcccctaccgtagtccgtaggaacggtattgggacggtccttaggtaacctttagttttaacgttcggtaccgaagggtaccgggttggggacctacgggtggtaccttaggtttcggaggggttcggttccggggacgggtaacggtaccgtaagggtttccggacccggttccgtaggggtaccaccgggaccgtacggtcccgtaccccggtccccggtagtaccccg

SEQ ID NO: 213537 - DNA, 694 bp, Homo sapiens
  misc_feature: GYAE6OF02IWJW2.34.59.F04.1.454.CMB.1.raw
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcagtggcatcagcaacagccacggaagggtcctcggttcttgatcgaaacttgacagtgatggcagccaacagtacggaagggggacggactaccgtaatcgcttcacgaggcctccgagtccgtcggtggggctacggacgccgtcccttcccgtacaactcgtaacttccctaccgaacggtccccctacgtaggttcctagggacgaattcggaacgggtcctagtaacctttatttacgttggtaccgaagggtaccgggttacgggggacctaacgtggggtacccttaaggtttccggaaggggtttcgggtacccgggggacgggtaaccggggtaaccgttaagggtttcccggggtaacccggttcggggttaaccgggggtaccctaacggggaccccccggtaaggggttccccgttacccccggccccccggttttacggggaccctttaccccggg

SEQ ID NO: 213538 - DNA, 670 bp, Homo sapiens
  misc_feature: GYAE6OF02HK3NH.34.59.F04.1.454.CMB.1.raw
  modified_base (365)..(365): a, c, t, g, unknown or other
  misc_feature (365)..(365): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaagggtcctcggttcttgatgaaacttgacagtgatggcagccacagtcgaagggggacgggatacccgtaagtcgcttctcaggctccagctcgtggggctggagcgcctcccgtnactcactcctccacgtccctccgacgttctaggagggtatgggacggttctagtaacttaatttacgttggtacgtaacggtacgggttcgggggactaaccggttcggggtaccttaacggttttccggtaaggggttttccgggtttccgggggaccgggggtaacgggggtaacccgttaaaggggttttccggtaaccccgggttcccgggttaagggggttacccgaacgggtacccccggtaaaggggtccccgtttaccccgggtcccccccggtttcggggtaccccttaaccccgg

SEQ ID NO: 213539 - DNA, 499 bp, Homo sapiens
  misc_feature: GYAE6OF02FGL83.34.59.F04.1.454.CMB.1.raw
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (355)..(355): a, c, t, g, unknown or other
  misc_feature (355)..(355): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacngccacggaaggtcctcggttcttgatgaaacttgacagtgatggcagccanatcgaagggggacggatcccctaatcgcttctcaggctccagctcgtgggctgagcgctcccnatcatctccagcctccagtctgagatgagctgactattatgtcagacgtgggcacgtggcattcgaggtgttcgggcggagggaccgtaaggttcgacccggtccgtgggtccacggcccgaaggcctcggccccctggtaccc

SEQ ID NO: 213540 - DNA, 667 bp, Homo sapiens
  misc_feature: GYAE6OF02I4SWP.34.59.F04.1.454.CMB.1.raw
  modified_base (187)..(187): a, c, t, g, unknown or other
  misc_feature (187)..(187): n is a, c, g, or t
  modified_base (225)..(225): a, c, t, g, unknown or other
  misc_feature (225)..(225): n is a, c, g, or t
  modified_base (430)..(430): a, c, t, g, unknown or other
  misc_feature (430)..(430): n is a, c, g, or t
tcagtacacgtgatcacgaccggtgctcgatttagtacacacacttagggattgggggagctctggggagtctgcaccatggcttggaccccactcctcttcctcaccctcctcctccactgcacgagggtctctctcccagcctgtgctgactcaatcgccctctgtctctcgcctccgtgggacncctcggtcaagctcactgcactctgagcgagtcgaacncactccacctacgccatcgccatcggcatcgagaccaacacgccgacgggacggtcctcggttctagatacgtaacgttcgactaggtgacgtgacacgccgatactacgaaggtcggggacggactaccgtaagtcgtcgttacgtcgacggctaccgacgtctacggtcgggtactcggacgccgtcgttcccgatacgtacncgttaccgtaccgactcccgtacctagttctacgggagtcgtacgagtcctagccttaagtttgtcgtaggaaccgggttgtacggggccctaagggtgtaccttacggttccggtacgggggttttacggcccggggaacccggggttaaaggggaacccgttttagggtacccgggttacccggttaaccgggtttccggggaaaccctaccggggtaacccccgttaccggggg

SEQ ID NO: 213541 - DNA, 548 bp, Homo sapiens
  misc_feature: GYAE6OF02GHWSV.34.59.F04.1.454.CMB.1.raw
  modified_base (331)..(331): a, c, t, g, unknown or other
  misc_feature (331)..(331): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgccctccctgggagcctcggtcaagctcacctgcactctgagcagtgaacacatcacctacgccatcgcatggcatcagcaacagccacggaaggtcctcggttctgatgaaacttgacagtgatggcagccacagtacggaaggggggacggactccccgtaatccgcttcncgaggctccgagctcgtggggctggacgccgcctccctcactccactcctccacgtccctccagtctaggaggatggaggtctagtacttattatgtcgaggtacggtggggcctagtggctagttcggagggttcgtcgggcggagggtaccgtaaggttcgacccggttcgtgggtaccgacggcccgaggcccgtccggtcccccgtggtaccc

SEQ ID NO: 213542 - DNA, 747 bp, Homo sapiens
  misc_feature: GYAE6OF02H0TL0.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctcccgtgggagcctcggtcaagctcacctgcactctgagcagtgaacacatcacctacgccatcgcatggcatcagcaacagccacggaacgggtcctcggttcttgatgaaacttgacagttgatggcagccacagtacgaagggggacggactccctaagtcgcttcgcgacggctccgagctcgtggggctggacgccgtcctcccgtacacgtcctaacgttccctacccgaggtcccccttacggaacggtttccgtagggaacgggtaagtttacggggaacggggtcctttaagggaaaccctttttaaagtttacggtttacggtaccggtaaacggggtaaccgggttcggggggaaccttaacgggttacggggtaccttaacgggttttccgggaacgggggttttcggggtttacccgggggacggggttaaccggggtaacccgttaaaggggtttttcccgggaaacccgggtttccgggttaacgggggttaccccaaccggggttacccccggtaaaacggggttccccgtttaacccggggtaccccccccgtttgggggttaaccccc

SEQ ID NO: 213543 - DNA, 546 bp, Homo sapiens
  misc_feature: GYAE6OF02I0ZCK.34.59.F04.1.454.CMB.1.raw
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagcaacagccacggaagggtcctcggttcttgatgaaacttgaacngtgagtggcagccacatacggaagggggcgtatccctaatcgcttcncaggctccagctcgtggggctggacgccgcctccctcatcacttcctaccacgtccctccgagtctaggaggagtggacggtctagtacttagtttatgtacgaggtacggtgggcacgtggactagttcgtagggtcgttcgggcgggtacggaccgtaaggtcgaccgttcgacgggtcacggacccggtaaggtccgtccggtccccgtggtccg

SEQ ID NO: 213544 - DNA, 605 bp, Homo sapiens
  misc_feature: GYAE6OF02FRPN5.34.59.F04.1.454.CMB.1.raw
  modified_base (292)..(292): a, c, t, g, unknown or other
  misc_feature (292)..(292): n is a, c, g, or t
  modified_base (370)..(370): a, c, t, g, unknown or other
  misc_feature (370)..(370): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaaggtcctcggttcttgatgaaacttgacagtgatggcagccanagtcgaagggggacggtactaccgtaatcgtcttctcgaggcctccgagctcggtggggctggacgccgtcctccctnacttccactcctcgacgtccctcgacgttccgtaggaggactggacggcttacgtaacttattagttcgtacgaacggtacgggtcggggcctacggtggaccttaacgttcggaggggtttcgttaccggggacgggtacgggtaacccgtaagggtttccggacccggttccggtacgggtaccaccgggtaccccgagggtccctacccggtcccccggttggtccctaccg

SEQ ID NO: 213545 - DNA, 663 bp, Homo sapiens
  misc_feature: GYAE6OF02ICO3K.34.59.F04.1.454.CMB.1.raw
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccgaacggaacgggtcctcggttcttgatagaaacttgacagtgatggcagccacagtcggaaaggggggacggacttacccgtaatccgtcttctacgagggcctccgaagccttacggtcggggctagggacgccgtcctaccccgtgaacgttcctaacgttccctacccgaacgtccccttaccgtacggttcctagggtaacgggacttggaacgggtccttagggttaactttagtttaatttcggtccgaacgggtacgggttcggggacctacgggttgggacttaacgtttcgggtagggttcggtaccggggtacgggacgggtaccctaagggttccggtaacccggttcggtacgggtcctaacgggccccaagggtcccgttcccggacccccgttaggtcctacccg

SEQ ID NO: 213546 - DNA, 743 bp, Homo sapiens
  misc_feature: GYAE6OF02IE1NE.34.59.F04.1.454.CMB.1.raw
  modified_base (196)..(196): a, c, t, g, unknown or other
  misc_feature (196)..(196): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactcngagcagtgaacacatccacctacgccatcgcagtggcatcagacaacagccaacgggaacggtcctcggttcttgatagaaacttgacagtgagtggcacgccacgacgtacggaaggggggacggactacccctaagtcgtacttcgtacgaggctccgaagccgttcgtgggggtctaggacgtccgtcccttccccgttctaacgtacctacttacccgtaccccgtacgtccccttaccgtacggtacgttacggaacgggtacgttacggggtaacggtcccgttaggttaacccgtttaagttttacgttacggttccggaaacgggttacggggttacgggggaccttacggttcggggtaacttacggttacggtacggggttccgggttaccggggaacgggggtaaccgggaaccggtttaacgggtttacccgggacccggtttacccgggttacgggtaaccccggtaccgggtaccccggtaaacggggtcccccgttacccgggtacccccccggttaccgggttaaccccgg

SEQ ID NO: 213547 - DNA, 601 bp, Homo sapiens
  misc_feature: GYAE6OF02I7ZK0.34.59.F04.1.454.CMB.1.raw
  modified_base (164)..(164): a, c, t, g, unknown or other
  misc_feature (164)..(164): n is a, c, g, or t
  modified_base (185)..(185): a, c, t, g, unknown or other
  misc_feature (185)..(185): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctntgtctctgcctccctgggacncctcggtcaagctcacctgcactctgagcagtcgaacacatcacctacgccatcgcatggcatcagacaacagccaacgggaacggtcctcggttcttgatagaaacttgacagtgagtggcagccacagtacggaagggggacggactacccgtaagtcgtccttctacgacggtcctaccgacgtctcggtggggctaggacgcgtcctacccgtcacttccactcctccgacgtccctaccgtacgttccgtaggacggtatcggacgtctacgtactttagttacgttcgtacgacggtacgggtacggggctacggtgactagttcgacgggttcggtacgggcggtaacgggtaaccgtaggttccggtacccgttcggtacgggtaccacgggacccgtaagggtcccg

SEQ ID NO: 213548 - DNA, 589 bp, Homo sapiens
  misc_feature: GYAE6OF02FMOGV.34.59.F04.1.454.CMB.1.raw
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaaggtcctcggttcttgatgaaacttgacagtgatggcagccacatcgaagggggacggatccctaatcgcttctcaggctcagctcgtggggctgagcgcctccctcatcatctccagccctcagtctgaggatggagtctagacttatattgtacaggacggttgggctacgttggactagtttaccgagggttcgttaccgggacgggtaggggtacccgtaaagggtttcggaaccccgggtttcccgggtagggggttacccaacggggtcccccggtaaacggggtccccgttcccgggacccccccccggtttacgggtaccccttaaccccgg

SEQ ID NO: 213549 - DNA, 756 bp, Homo sapiens
  misc_feature: GYAE6OF02JX7N1.34.59.F04.1.454.CMB.1.raw
  modified_base (170)..(170): a, c, t, g, unknown or other
  misc_feature (170)..(170): n is a, c, g, or t
  modified_base (189)..(189): a, c, t, g, unknown or other
  misc_feature (189)..(189): n is a, c, g, or t
  modified_base (747)..(747): a, c, t, g, unknown or other
  misc_feature (747)..(747): n is a, c, g, or t
tcagtacacgtgatcacgaccggtgctcgatttagtacacacacttaagggaaggttggagtcgtgccaccattggcctttggaccccactacctcttccgtcacccctcctcctccactgccacgaggtctctactccagcctggtcgcgtgactcgaagtcgcccttntgtctctgcctcctggacncctcgtcagcctcacctgcactcgtcgacgcagtcgaacacagtcacctacgaccacttccgctaagtcgggactactaccaacgccaaaccgtagacccgtaacggggttaaacggtcccttacgggttaccttcggaagttacggtaaaactttcggaaccgaacgggttcgaacgttacgggtacctaaacggtttaccccaaacggtaacgttaccgggaaacgggggggtaccggtaactaccccgtaaagtccggtctttacgtccgaacggtcctaccggtaacgtcccgtacggtgggtcctaggtaccgcccggtacttcccgtaatacggtccgaacgttcctccgaggccctagttacggttcgtaggtaacggtgtggccgtagtacgtacttaagtttatcgtacggtggtaccggtgggtaccttcgggacgacgtagttaccggtggttaccgggttacggcgggtaaacggtacgtaagggttccggacccgttcggacgggttacccacggtcccgtaaggtcccgtcccgttccccggtnttacccccg

SEQ ID NO: 213550 - DNA, 652 bp, Homo sapiens
  misc_feature: GYAE6OF02G8AQB.34.59.F04.1.454.CMB.1.raw
  modified_base (171)..(171): a, c, t, g, unknown or other
  misc_feature (171)..(171): n is a, c, g, or t
  modified_base (241)..(241): a, c, t, g, unknown or other
  misc_feature (241)..(241): n is a, c, g, or t
  modified_base (349)..(349): a, c, t, g, unknown or other
  misc_feature (349)..(349): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggancctcggtcaagctcacctgcactctgagcagtgaacacatcacctacgccatcgcatggcatcagcaacngccacggaaggtcctggttcttgatgaaacttgacagtgatggcagccagagtacggaagggggcgactcccgtaagtccgtcttcgtacgaggcctcgagtcgtcgnggggctggacgtcgtcctccctgtactcacgtccgtacccacgtccctaccgagtccgtagggacggtagtacggacggtcttacgtaacctttagtttaacgttcggtaccgtaagggtaccgggttacggggactaccgggttggaccgttagtttccggaagggtttcggttaccggggaccgggtacgggtaacccgttaagggttccggaccccggttccggtacggggtaccctaccgggtaccccgtaacggggtccccgttaccccgggcccccggttaggtacccctaacccgg

SEQ ID NO: 213551 - DNA, 616 bp, Homo sapiens
  misc_feature: GYAE6OF02GWPWG.34.59.F04.1.454.CMB.1.raw
  modified_base (296)..(296): a, c, t, g, unknown or other
  misc_feature (296)..(296): n is a, c, g, or t
  modified_base (331)..(331): a, c, t, g, unknown or other
  misc_feature (331)..(331): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccgacgggaagggttcctcggttcttgatgaaacttgacagtgatggcagccanagtacggaagggggacggatccctaatccgcttcncgaggcctccagtcgtcgtcggggctggacgcgtcctcccgtcactccatccctccacgtccctccgagtcctgggaagactggacggtctagacttagttacgttcggtacagggtaccgggtggggaccacgttgggaccttagttcgtagggttcggttccggggacgggtacgggtaccgtaagggtttccggaacccggtttccggtaggggtacccaacgggacccccggtaagggggtccccttacccggggtcccccccgttcgggtccctacccgg

SEQ ID NO: 213552 - DNA, 829 bp, Homo sapiens
  misc_feature: GYAE6OF02ICKBB.34.59.F04.1.454.CMB.1.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
tcagtacacgtgatcacgaccggtgctcgatttagtacacacacttaggggattggggggagctctgggggagtctgcaccatggcttggaccccactcctcttcctcacccctcctcctccactgcacagggtctctctcccagcctgtgctgactcaatcgccctctgtctctgccctcccgtgggacncctcggtcaagctcacctgccactctgancagtgaacacatccacctacgccatcgcatggacatcagacaaacgacgaccgaacgggaacgggttccttcgggtttacttagacttaacggtaaaacctttggaacctaggttacgaacgttggggaccaacggcccaaacgtaacggttaccggggaaaacggggggggtaaccggtacttaaccccgttaaagtccgggttaacctttcgtacgaacgggtcctaccgtaacggtccttacggttcggggggtacctgggtaaccggtccggtacccttaccccgttactaacttcctaaccgttcccttacccgaaccgtccccttacccgtaaggttaccgttagggaacgggtagtcgggtaacggtctaacggtaaccttttaaagtttaacgtttcgtaaccggtaacgggttaccggggtacggggtacctaaccggtggggtaacccttaggtttccggtaagggggttttccgggttaccgggggaaccggggtaaacggggtaaccccggtttaaagggtttcccgggtaaaccccggtttccgggttaccggggttaaccctaacggggttaccccccggaaggggttcccccgg

SEQ ID NO: 213553 - DNA, 725 bp, Homo sapiens
  misc_feature: GYAE6OF02HO3MF.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgccctcccgtgggagcctcggtcaagctcacctgcactctgagcagtgaacacatccacctacgccatcgcagtggcatcagacaacacgccaacggggacggtccgtcggttcttgatacgtaaactgacaggtcgagtcggcacggaccaatacgtacgggaaagggggaccggtactacccgttaacgtccggtaccttccgtacgacggtcctaccgacggtccgtcgggtacggggtctagggtaccgcccggtacccttccccgtacgtaacttccgtaacgttcccgtaccaccggtcccctaccgtacgttacggttaggaacgggtagttacgggaacggtccgtaacgttacgttaagtttacggttcgacgtacgggtaccgggtcgggtaccgtaacggttcggacttacggttacggtacgggttaccgggttccggggaaccggggttaacgggtaacccggttaagggttaccccgggacccggtttaccgggtacggggttacccgaaccgggtacccccggtaagggttacccccgg

SEQ ID NO: 213554 - DNA, 642 bp, Homo sapiens
  misc_feature: GYAE6OF02G8PVU.34.59.F04.1.454.CMB.1.raw
  modified_base (172)..(172): a, c, t, g, unknown or other
  misc_feature (172)..(172): n is a, c, g, or t
  modified_base (296)..(296): a, c, t, g, unknown or other
  misc_feature (296)..(296): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggacncctcggtcaagctcacctgcactctgagcagtgaacacatccacctacgccatcgcatggacatcagcaacagccacggaacggtcctcggttctgatgaaacttgacagtgatggcagccaanacgtacggaagggggacggactccccgtaaatccggtacttcgtcacggtctccgacgtctccggtggggcctagacgccgtcctcccgtcactccacttccgtaccacgtccctacgacgtctaggacggtatgggaggtccttagaaccttattttacgtcggtacgaacggtacgggttcggggacctacggtgggacctacggtttcgtaagggttcggttacggggacgggtaacgggtaacccgttaagggtttacccggacccgttccggttacggggtaacccgtacgggaccccggaaagggtccccgtttccccggaccccccggtttagaccccg

SEQ ID NO: 213555 - DNA, 714 bp, Homo sapiens
  misc_feature: GYAE6OF02HO1G9.34.59.F04.1.454.CMB.1.raw
  modified_base (244)..(244): a, c, t, g, unknown or other
  misc_feature (244)..(244): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctcccgtgggacgcctcggtcaagctcacctgcactctgagcagtgaacacatccacctacgccatcgcatggcatcagcaacngccacggaaggtcctcggttcttagatagaaacttgacaggtcgagtcggacacggccaacgagttacgggaaaacggggggggaccgggtaacttacccccgttaaaggttcccggtacctttttcccgaccggtaacggggtccttaccccgaggttccgttacgggtcggggggtcctaggaacggtcccggtcccttccccgttactacttccaaccttccctacccgtacggtcccccttccgacgttccgtgggaacggtagtggacgggtcctacggttaccttagtttacgtttcgtacgtaacgggtcggtcgggggacctacggtcggtactacgtttcgaggggttcgttaccgggggcggtagggtaacccgtaaggtttccgggtacccggttcggccgggttacgaccggtcccggtaacggtccccttcccgggtacccccggttcggtaccccg

SEQ ID NO: 213556 - DNA, 566 bp, Homo sapiens
  misc_feature: GYAE6OF02IBWKN.34.59.F04.1.454.CMB.1.raw
  modified_base (172)..(172): a, c, t, g, unknown or other
  misc_feature (172)..(172): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatccgccctctgtctctgcctccctgggancctcggtcaagctcacctgcactctgagcagtgaacacatcacctacgccatcgcatggcatcagcaacagccgacggaagggttcctggttcttagatagtaaacttgacngtgatggcagcanatcgaaggggcggatcctaancgctcncagctcngctcgtgggctgacgcncctacctnactcactcctaccgacncctcctaggtcaggaggactgggacggtntacgtaacttacgttattcgtacgaggtaccgggttacgggcaacgttggactagtttcgagggtttcgtacgggccgggtaagggacctaaggttcggtacccgtacggtgggtaccacgggaccccaggtcccgtcccggtaccccgtttacggcctaccgg

SEQ ID NO: 213557 - DNA, 646 bp, Homo sapiens
  misc_feature: GYAE6OF02G1R3A.34.59.F04.1.454.CMB.1.raw
  modified_base (505)..(505): a, c, t, g, unknown or other
  misc_feature (505)..(505): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgccctcccgtgggagcctcggtcaagctcacctgccactctgagcagtgaacacatccacctacgccatcgacagtggcatcagacaacacgacccgaacgggtaacgggtccttcgggtttcttggaatacgtaaaacttggaacaggtgagttggacagccaacgtagtacgggaaacgggggggaccgggtacctacccgttaaagtccggtcctttacgcgacgggtccttaccgagtcgtccggtggggtacctggacgccggtccctccctcactcactcctaccgacgcccttacgagttccgtagggagtcgtggacgtcttagacttattagtcgganagggtaccgggtgggacctggtcgactcgttggacgggttcgttacgggacggggtaaggtaccgtagggttacgtaccccggttggtacggggttaccacgggtccccggaaggttccctcccgggtcccccgtagtccc

SEQ ID NO: 213558 - DNA, 691 bp, Homo sapiens
  misc_feature: GYAE6OF02F4NG7.34.59.F04.1.454.CMB.1.raw
  modified_base (456)..(456): a, c, t, g, unknown or other
  misc_feature (456)..(456): n is a, c, g, or t
  modified_base (518)..(518): a, c, t, g, unknown or other
  misc_feature (518)..(518): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatccgccctctcgtctctcgccctcccgtgggacgtccgtcggtcaagctcacctgccactctgacgcagtcgaaacacactccacctaccgaccactcgcagtcggcatcacgacaaacacgaccgaacgggaacggttccgtcggttctgactacggtaaacttcgacgtaggtcgagtcggcacgccaacactacgaacggtcggggaacggtactacccgtaagtccgtcctttccgacgacggtcctaccgacgtccgttcgggtcgggtctaggacgtccgttccctacccgtanactaccgtaccttacccgaccgtaacgcccctttacgaaggtttccaaaggtacgggtaacnccgggtacgtcttaacgtaacctttaagtttccgttgacgtagggcgggttacggaccttagtcgggacttagtttcggacgggtttcgggaccgggacggggttaaaccggacgttaacggggttccgtaacccggttccggtaagggacccctaacggcccggtaaccggg

SEQ ID NO: 213559 - DNA, 626 bp, Homo sapiens
  misc_feature: GYAE6OF02HIR7W.34.59.F04.1.454.CMB.1.raw
  modified_base (362)..(362): a, c, t, g, unknown or other
  misc_feature (362)..(362): n is a, c, g, or t
  modified_base (413)..(413): a, c, t, g, unknown or other
  misc_feature (413)..(413): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgcatcgcatggcatcaagacaaacacgaccaacgggaacgggtccctcggttccttgaatagtaaacgttgacgagtgagtcggcacgccaacagtacggaaagggggacgactcctaagtcgtcttacncgacggtctaccgacgtcgtacgtcggggctggaccgcgtccctacccgtnaactcgaacttccaccgtacgtccctaccgtaggtactgggaagtacgtggaacgttctagaacttagttacgttcgtactaggtaacggtcggggactacggtcgacttaacgttcggtaacggttcgggttacgggcggggtaacggtaacctacgggttacgtaccccgggttggtaccggggtacctaacggacccgtaaccggtcccg

SEQ ID NO: 213560 - DNA, 699 bp, Homo sapiens
  misc_feature: GYAE6OF02HK0GL.34.59.F04.1.454.CMB.1.raw
  modified_base (185)..(185): a, c, t, g, unknown or other
  misc_feature (185)..(185): n is a, c, g, or t
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctccctgggacncctcggtcaagctcacctgcactctgagcaggtgaacacatccacctacgcaatcgcagtggcatcgagacaaacgcgaccgagggaacgggttcctcggttctgatacgtaaacttgaactagtgatggcagccagacgtacggaaacgggggcgtactaccgtaagtccgtcttcctacgacggtcctccgacgtccgtacggtcggggctagggaccgtccgtcccttcccgtacgtacttcctaccttcccgtaccgacccgtcccttaccgtacggtccgtacgggtaacggtacgttagggacggtccttaacggtaacttttaagtttacgtttcggtaacgtacgggttaccggggttccggggaaccttacgggttcggtaccgttacggttaccgtaggggtttccgggtaccggggaccggggtaacggttaaccgtacgggtttacccgacccgggtttcggtaccgggttaccggacccggtacccggtagggtcccccgg

SEQ ID NO: 213561 - DNA, 776 bp, Homo sapiens
  misc_feature: GYAE6OF02FOAPI.34.59.F04.1.454.CMB.1.raw
tcagtacacgtgatcacgaccggtgctcgatttagtacacacacttagggattggagtctgcaccatgggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacgggaagggtcctcggttcttgatgaaacttgacagtgatggcagccagatacggaagggggggacgggtataccccgtaagtccgtacttctcgaacggcctaccgagtccctcggtcggggcttgggacggtccgtacccgttccctacacgttcctacttcccgtacccctaacggtcccctacccgacgtttccgtagggaacgggtagtcggggaagggtccttagggtaaaccctttaagtttttaacggtttcgggttaccggtaaacgggggtaacggggttacgggggggaccttaacccggttaggggaccgtttaaggttttcccggtaaaggggggtttccggggtttaaccgggggacccgggggtaacggggggtaaccccgttaaacgggggtttaccggtaaacccccgggggttcccggtttacggggggtacccgtaaccgggtaccccggggtaaaccggggttccccgtttacccccgggtaccccccgggtttacgggttaacccccgg

SEQ ID NO: 213562 - DNA, 741 bp, Homo sapiens
  misc_feature: GYAE6OF02F99Q1.34.59.F04.1.454.CMB.1.raw
  modified_base (165)..(165): a, c, t, g, unknown or other
  misc_feature (165)..(165): n is a, c, g, or t
  modified_base (235)..(235): a, c, t, g, unknown or other
  misc_feature (235)..(235): n is a, c, g, or t
tcagtacacgtgatcacgaccggtgctcgatttagtacacacacttagggattgggggagctctggggagtctgcaccatggcttggaccccactcctcttcctcaccctcctcctccactgcacgaggtctctctcccagcctgtgctgactcaatccgccctntcgtctctcgccctccgtgggactccgtcggtacacgcctcaccgtgcctactcgtgacgcagtcgaacncactccacctacgcctatccgcagtcgactactcacgacaacgacggaccgaacggtacggttccttcgggttctagacgtacgtaacttcgacgagtagacgtcggacacgacctaacgtactacggtaagggtcggggaaccgtaccttaccgtacgtccgttcttacgacgacggcctaccgacgtccgttcgggtcgggtacctcggacgtcccgtcctacccgtacgtacttccgaaccgttccgacccgtacctccctaccggtacgttcgaacgggtacggtactcgggtaacgttcgttaacggtttaacttacgtttagttaccgggacgttaacgggtccggttagggacccttaggggtacgtaccgtttaccggttacgggtaccgggtttcgggggtacccgggaaccggggtaaccggttaacccggttacgggttcccgtacccgggtttaccgggttacgggaccggtaccccgggtacccggtaccggg

SEQ ID NO: 213563 - DNA, 734 bp, Homo sapiens
  misc_feature: GYAE6OF02H7V2Q.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctccagcctgtgctgactcaatcgccctctgtctctgcctcccgtgggacgcctcggtcaagctcacctgcactctgacgcagtgaacacatccacctacgcatccgcagtggcatcagacaacgagccgaacgggaagggtcctcggtttctgatagaaacttgactagtgagtggctacgccaacgtacgtacggaaacggggggacgtactacccgtaagtccgtcttccgtacgaggtcctacgacggtcctacggtcggggctaggacggtccggtcccttacccgtcgtaacttccgtaccgttccctacccgtaacgccccttacgaaggtttcccgtaagggtaacggtacgtacggggaaccggttccgtttaacggtaacttttacgtttacgtttaccggtacggtaaccgggttacggggttccgggtaaccgtaccggttcggggttaactacggtttacggacggggtttacggttaccggggaccggggtaacgggtacccggtaagggtttaccgggtacccgttacccgggttagggtacccgaccggtcccgtaacggggtcccgtcccggtaccccccggttggttaacccccg

SEQ ID NO: 213564 - DNA, 758 bp, Homo sapiens
  misc_feature: GYAE6OF02F7ST3.34.59.F04.1.454.CMB.1.raw
  modified_base (140)..(140): a, c, t, g, unknown or other
  misc_feature (140)..(140): n is a, c, g, or t
  modified_base (260)..(260): a, c, t, g, unknown or other
  misc_feature (260)..(260): n is a, c, g, or t
tcagtacacgtgatcacgaccggtgctcgatttagtacacacactttagggtaggttgggggagctctggggagtctcgcacctatgggcttggaccccgactccctcgttcctcggaccctcctcctccactgctacgngggtctcgtctcccgagcctgtggctgactcaatcgcccttctgtcctctcgccctcccgtgggacgccctcggtactaacgcctaccacctgcctactctgacgctacgtacgtaaccncgacttccacctacgcctaacttcgactagttcggcctaactcgagaccaaacgacgaccccgaagggaacgggttccttccgttcgtagacgtacggtaaacttgaaccaggtcgtacgtcggtactaccgtaccaacgtacgtaacgggaaaacgggggtccgtaactacccgttaaagtcgtccgttacgtacgaacgggtccttaccgaacggtcccgtaccggttacgggggaccgtcggaacggtcccgtccgtaccccgttacaccgttaacctacgttcccttacccgtaccgttacctaaccgtaccggtttaacgtacggtaacggtacgtacggtaacggtcctacgtaaccggtttaatacggttcgtactaacggttaccgggtggtaccacgtacgacgttaccgtacggtagggtcggttcgggaacggttacggtaccgtaagtccgaaccggtcgtaacggccgacgtaccggagtacccg

SEQ ID NO: 213565 - DNA, 686 bp, Homo sapiens
  misc_feature: GYAE6OF02HN72D.34.59.F04.1.454.CMB.1.raw
  modified_base (151)..(151): a, c, t, g, unknown or other
  misc_feature (151)..(151): n is a, c, g, or t
  modified_base (336)..(336): a, c, t, g, unknown or other
  misc_feature (336)..(336): n is a, c, g, or t
  modified_base (652)..(652): a, c, t, g, unknown or other
  misc_feature (652)..(652): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctntgtctctgccctcccgtgggacgccctcggtacaagcctacacctgccactcgtgagcagtacgaacacatccaacctacgccaatcgacagtcggacatcgacgacaacgacgaccgaacgggaacgggttcccttcggttacttagatagtaaacgttgacaggtgaagtcggacacgaccanacggtacggaaacggggggtacggtactacccgtaagtcgtacttacgtcgaacggtcctaccgacgtcgtcggtgggggacttaggacgtcccgtaccctcccgtactactaccgtaccttccgtacccgtaaccgtccccttaaccgtacggtttacggcgggtaaggacgttaggaacggtacgttacgtaacttacgtttgtaccgtacgacgggtacgggtacggtcctacgggtcgtagttacggtacgtaggggttcgggtcgggacgggtaacggtaccgtaaggtcggtaccggtcggtcggtaacnccggtacggacggtcccaccgtcccgttaggtcc

SEQ ID NO: 213566 - DNA, 630 bp, Homo sapiens
  misc_feature: GYAE6OF02F3VXP.34.59.F04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatcggcatcagcaacagaccaacgggaacgggtcctcggttcttgatgaaacttgacagtgagtggcacgccaanagtacggaagggggacggactaccgtaagtcgtcttctcgacggtctaccgagcttcggtcggggtctggacggtccgtcccttcccgtcactacgactcctaccacggtccctaccgtacgtcgtaggacggtagtcggacggtcttacgtaacgtttacgttagttcgtacgtacggacggttggggctacggtcggtaccgtagttcggtagggttcggttacggggacgggtaacgggaccgttaagggttccggtaccggttccggtacgggtaccgacggtacccggtaacggcccgttacccggtccccggttacggtcccg

SEQ ID NO: 213567 - DNA, 912 bp, Homo sapiens
  misc_feature: GYAE6OF02F5G7Z.34.59.F04.1.454.CMB.1.raw
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctcgcctcccgtgggacgtcctcggtacaacgtcctccaccgtgccaccttcgtagacgacgtaggtacgaaaccacctactacccacccgttaccgacctaacgtccgacctaggtcggacctacgtaccgaacgaccaaaccgaccggtaccccggaaccgggggttaaaccgggtttccccggtttaccgggtttaccgtttaaggtaacggtttaaaccggttaaaccgttacggaaaccgtaggttacggaaggttaccggaccgaaccgtaccgaacgtaacgggtaaccgggggaacgggggtaaccgttacccgtaccccgttaacggttcccgtaccgtttaccgaccggtaccggttacccgtacccggtacggttccggttaccgggtacgggtcgtacgggtaccggtccctaccccgttccctacctacgtaccgaccttcccgtaacccaccgtccccttaccggtaggttaccggtaaggggacgtacgggtacgttaccggttacttaaggtttaactttacgttcggttacgaaccggacgggttcgggtacgtaccggtaccggttagtaccgttggtttacgggacgggtttaccgggacggggtaccgggtaacgttaccggttaccgggttcccggaacccggggtttccggaacgggttaccccgaacccgggtacccgttacggggttcccccgtaccccgggttaccccgtttcgggtaaccccttccccgg

SEQ ID NO: 213568 - DNA, 613 bp, Homo sapiens
  misc_feature: GYAE6OF02JBQSK.34.59.F04.1.454.CMB.1.raw
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (475)..(475): a, c, t, g, unknown or other
  misc_feature (475)..(475): n is a, c, g, or t
  modified_base (523)..(523): a, c, t, g, unknown or other
  misc_feature (523)..(523): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctctgtctctgcctcctgggancctcggtacaagcctcactgcactcgtgancagtcgaacacatccacctacgccatcgcatggacatcagcaacacgccgacgggaacggtcctcggttcgttagatagtaaacttcggaacaggttgagtcggacncgaccactacgacggaacggggggacgactacccgtaactccgtcttcgtcgtagccttacacgtcgtcgtggggtctgacgtccgtccgtccgtactactactactccctaccgccgtacccgtccacggttcacggtacgtggtacgcgtacgtgtaattacgttnttgacgtagcgggtaggcacgtagcttacgtcgtaggtcgttcggggngtacgggtacgtacgttcggaaccttcgggtcggtaccgtaccggaccgttacgggtccgtccgtaccccggttacggtccgttacccgg

SEQ ID NO: 213569 - DNA, 829 bp, Homo sapiens
  misc_feature: GYAE6OF02J1RWA.34.59.F04.1.454.CMB.1.raw
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatccgccctctgtctctcgcctcccgtgggacgcctcggtcaagctcacctgcactctgagcagtgaacacatccaccctacgccatcgacagtggccatcagccaaacnggccgaacgggacgggttcctggttctagatagtaaacttgacaggtnatggaccacgaccanacgtacgggaaacggggggacgtaccttaccgtaagtccgtacttccgacgaacggtccctaccgaggttcctcgggtacggggcttaacggcgtcccgtcccttacccgtacacgtactacgtaccgtccgaaccgtcccgttaccgtacggttccgtaacgggtacggtacgtacgggtaacgggttccgtaaacggttacccgtttaaagttttcggtttaccggtaaccgggtaaaccgggttaccgggggtaccggggtttaacggtaaccggtttcgggggtaaaccctttaggggttttaacccggtaagggggttttcccggggttaaccgggggttaccgggggtaaaaccgggtttaacccgggtaaacggggttcccggttaaaccccggggttttccggggttaccggggttaaccccgggaacccgggttaacccccggggtaacgggttaccccggttccccccggggttcccccccgggtttaacgggtttacccccgg

SEQ ID NO: 213570 - DNA, 648 bp, Homo sapiens
  misc_feature: GYAE6OF02FSMFQ.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctcccagcctgtgctgactcaatcgccctctgtctctgcctcccgtgggagcctcggtcaagctcacctgcactcgtgagcagtcgaacacatcacctacgccatcgcatggcatcagcaaacacgccgaacgggtaacgggttccttcgggtttctggatacggtaaacttcgacagtgagtggcagccaagagtacggaaggggacgactaccctaagtcgcttctacgagtcctacacgtcgtcggtacggggtctacggacgcgtcctaccctactactctacgtccgtaccacgtaccctaccgtacgtccgtaggacggtagtacgggacgtacgtacggttacttaacgtttacgttcgtacggtacggtacggttcggggactacggtacggctaacgtttcggtacgggtttacggttcggggacgggtaacggggtaaccgtaagggttaccggtacccggttaccggttacgggtaccggtacggtacccggtacggtcccgg

SEQ ID NO: 213571 - DNA, 650 bp, Homo sapiens
  misc_feature: GYAE6OF02H2TI4.34.59.F04.1.454.CMB.1.raw
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctcgcctccgtgggacncctcggtcaacgctcgacctgcactctgacgcaggtnaacacatccacctacgccatcgnatgcatcacgacaacacgccgacgggtacggtcctcggttntgatacgtaacttgacagtgagtggaccaaccanacgtacgggaaggggtacggactaccgtaatccgtcttcgtcgacggtccgtcgacgtcgtcgggtcggctcggacgtaccgtccctccgtacactccgattcccgactccgtcccctacgtacgttcgaggacgtcgtacggaacggtcctaagttactttagtttaacgtcggtaccggtaaggggttccggtcggggtaaccgtgttaccggtattacggttcggtagggttccgggtaggggaccgggtacgggttaaccgtagggttcccggtaccggttcggttacgggccgtacggaccggtacgtccccgtcccggcccgttgtacccgttccg

SEQ ID NO: 213572 - DNA, 681 bp, Homo sapiens
  misc_feature: GYAE6OF02H55CA.34.59.F04.1.454.CMB.1.raw
  modified_base (428)..(428): a, c, t, g, unknown or other
  misc_feature (428)..(428): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgcactcgcatggcatcagcaacacgccacggtaaggtcctcggttcttgatgtaaacttgactagtgagtggcacgccacacgtcgaagggggacggtactcccgtaagtcgtcgttctcgaggtcctccgacgtcgtcggtgggggtcctggacggccgtcccgtccctcgaacttctaactccctaccacgtccctaccgaagttccnggaaggtatacgggacggtcctaggtaactttattagtcggttaacgaggtacgggttcggggacctacggtcggtacctaaggtttccggaaggggtttcggtacccggggtaggggtaaccgggttaaccgtaaacggggttcccgggttaaacccggttcccgggtttacggggtaccccgtaccgggttaacccggaaaccggttcccgggttacccgttccccccccggggttagttaaccccccggg

SEQ ID NO: 213573 - DNA, 759 bp, Homo sapiens
  misc_feature: GYAE6OF02IQ17D.34.59.F04.1.454.CMB.1.raw
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatccgccctctgtctctgccctcccgtgggacgcccgttcggtacaacgccttaccacctgcctacctctgacgcagtacgaacacactaccacccgtaccgcctatccgcagtcggacactcacgaccaaacgacggaccgaacgggtaacggtccgttcggttctgactagtaaacttgacgtagtagagtggcacgaccatacgtacgggaagggggaccggtacttacccgtaagtccgtacttccgacgtacggtcctaccgacgtcgttcggtcggggtctacggaccgccgtcccttcccgtctactacctaccgttacccgtacccgtaaccgtcccctaccgtacgttccgtagggtaaccggtaggtaccgggtacggttacttacggtaacgtttaacgttttacgttcggtaacggtacgggtaaccggggtcgggtaaccgtacggttacggttaccgttaggtttacggtacgggtttcgggtaccgggtacggggtaacgggtaccgttaacgggtccggttacccgtcgggttcggaaccgtacccggaccggtaacggttcccgtaccccggtaccccggtttccggacccttaccccgg

SEQ ID NO: 213574 - DNA, 723 bp, Homo sapiens
  misc_feature: GYAE6OF02F954A.34.59.F04.1.454.CMB.1.raw
  modified_base (134)..(134): a, c, t, g, unknown or other
  misc_feature (134)..(134): n is a, c, g, or t
  modified_base (218)..(218): a, c, t, g, unknown or other
  misc_feature (218)..(218): n is a, c, g, or t
  modified_base (577)..(577): a, c, t, g, unknown or other
  misc_feature (577)..(577): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtnctgactcaatcgccctctgtctctcgccctccgtgggcgccttcggtcaagcctcacctgacactctgacgctagtgaaccacntaccgaacctccgcctatccgcagtcggaccaattccaacgccaaacgcggacccgtaacggggtaaccggtttcccgtccgggttttccgtagtaagtcgtaaaaaccgttcgtaaacctggtaggagtttcgggacaccggaccttaacgaacgttacggaaaaggggggtccggtaaaccttaccccttaaaggtccgtacttcccgtacgtacgggccttaacgcgttccgtcggtcggggcttagaccggcctccctccccgtatacgaccttactcccgaacggtcctcccgtacgttaccgtcggttgaacccggtagttacgggagtccgttacgttaaccttaacgtttnttccggaactaagggtcccgtgggtaccacgtcggactaggttacctggggtacttcggggaacgtttacggaaccggtttgtaccgggtccttgggtcggtaacaccggttaccgaccggtcgtaccccggtcccgtgtaacccg

SEQ ID NO: 213575 - DNA, 728 bp, Homo sapiens
  misc_feature: GYAE6OF02JCLJ0.34.59.F04.1.454.CMB.1.raw
  modified_base (144)..(144): a, c, t, g, unknown or other
  misc_feature (144)..(144): n is a, c, g, or t
  modified_base (190)..(190): a, c, t, g, unknown or other
  misc_feature (190)..(190): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (268)..(268): a, c, t, g, unknown or other
  misc_feature (268)..(268): n is a, c, g, or t
  modified_base (422)..(422): a, c, t, g, unknown or other
  misc_feature (422)..(422): n is a, c, g, or t
  modified_base (470)..(470): a, c, t, g, unknown or other
  misc_feature (470)..(470): n is a, c, g, or t
  modified_base (533)..(533): a, c, t, g, unknown or other
  misc_feature (533)..(533): n is a, c, g, or t
  modified_base (598)..(598): a, c, t, g, unknown or other
  misc_feature (598)..(598): n is a, c, g, or t
tcagtacacgtgatcacgaccggtgctcgatttagtacacacacttaggagttggggagctctgggagtctgcaccatggcttggaccccactcctcttcctcaccctcctcctccactgcacaggtctctctcccagcctgtnctgactcaatccgcccttcgtcgtcctctgaccctcccgtgggacncctcggtacaaggctaccgctgccactctgancagtcgaacacnctaccaccgtaaccgcctaatcgcagtcggtacncgtacaagccaacgccgaccgaacgggtacggttcccgtcggttacttcgaacgttacggaaaactttcggaacctaggttacgaacgtcgggctaccggacctaacgactacgaaacggtcgggaaccggtactacccgtaagccgtcttacngacgtccgtacacgtctaggtcgggctaggacgtcctcccaccgttanaccgtccgaacttccgaccctaggtcccctacgtacgttccgaggtacgtcgtacgggtaacnccgttaataaccgtttaactttacggtacgtaccggaccgggttaaacgggtcggggttaaaccncggtttaccgacgtttacggttcggaccgggggtttaccgtaacggggtaccgggaaccggttaacccggtacggttttaacccggcgggttaccgttaaccggggtaccgtacggtacccgggtaacgg

SEQ ID NO: 213576 - DNA, 664 bp, Homo sapiens
  misc_feature: GYAE6OF02G0N44.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacacgccgaacgggtaacgggtcctcggtttcttgatcgaaacttgactagtgatgggcagccaacgagtacggaacgggggacggactccccgtaatcgtccttcacgacgcctaccagtccgtcggtggggtctcggacgcgtcctccctcatccacgttcctccgacgtccccgtacgtagtccgtgggaacgggtagtacgggacggtacgttacggtactttagttagtttcgaccgagggtacgggtcggggactaccggttggcctttagttacggtaagggttcgggttaccggggacgggtaacggggttaccctaaggggtttacccggtacccggttccggttaccgggggtacctaacccgggtcccggaaccgggttccccgtaccccggggttcccccgttacgggtacccc

SEQ ID NO: 213577 - DNA, 603 bp, Homo sapiens
  misc_feature: GYAE6OF02FL9IP.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccaacgggaacgggttcctcggttcttgatgtaaacttgacagtgatggcagccacatcgaaagggggcggatccctaatcgcttctcgaggcctccgagctcgtggggctgagccgcctccctctactcactcctccacgtccctaccgagtcgtagaggaagtggacggtctagtaactttattaattggtacaaggtacgggtacggggctacggtcggtactaacggttcgaagggtttcggtttaccggggacgggtacgggtaaccgttaaacgggttcggacccgggtttccgtacggggtaccgtaacggacccggtaacgggtcctcccgggtaccccccgttggtaccccg

SEQ ID NO: 213578 - DNA, 702 bp, Homo sapiens
  misc_feature: GYAE6OF02HU95K.34.59.F04.1.454.CMB.1.raw
  modified_base (293)..(293): a, c, t, g, unknown or other
  misc_feature (293)..(293): n is a, c, g, or t
  modified_base (394)..(394): a, c, t, g, unknown or other
  misc_feature (394)..(394): n is a, c, g, or t
  modified_base (467)..(467): a, c, t, g, unknown or other
  misc_feature (467)..(467): n is a, c, g, or t
tcagtacacgtgatcacgaccggtgctcgatttagtacacacacttagggattggagtctgcaccatggcttggacccccactcctcttcctcaccctcctcctccactgcacaggtctctctcccagcctgtgctgacctcaatccgccctctgtctctgccctcccgtgggatccgtcggtcaagtcctcacctgctactctagagcagtacgaacacgtactccaacctaccgaccactcgacagtggaccatacacgacaacgacgaccgacggacggttcctcggttntagagtacgtaaacgttgactaggtacgaggtcggactaccgaccactacggaccggtaacggggcgtacctaccgtatcgtcttcgcgtagccttaccgngtcctcggtggctacgacgcgtccctcccgataccgtcgtacctcctaccgaccgtccctcgtacgttaccgngggtaacgtgaacggtcggtacgtacgttaagttacttagtcgttcgagggttaaccggtggaccgttgtacgggtacttacggttaccggtgggtttaccgggtcgggtaacgggttacggaaaccggttaacggttaccccgggttaccggtcgggttaacccgggttcgtaaccccggaacggtaccccgggtttacccgtacccccgggttcccccggttacggtaccccg

SEQ ID NO: 213579 - DNA, 687 bp, Homo sapiens
  misc_feature: GYAE6OF02J0Y8V.34.59.F04.1.454.CMB.1.raw
  modified_base (164)..(164): a, c, t, g, unknown or other
  misc_feature (164)..(164): n is a, c, g, or t
  modified_base (474)..(474): a, c, t, g, unknown or other
  misc_feature (474)..(474): n is a, c, g, or t
  modified_base (514)..(514): a, c, t, g, unknown or other
  misc_feature (514)..(514): n is a, c, g, or t
tcagtacacgtgatcacgaccggtgctcgatttagtacacacacttagggattgggggagctctggggagtctgcaccatggcttggaccccatcctcttcctcaccctcctcctccactgcacagggtctctctcccagcctgtgctgactcaatccgccctntgtctctgccctcccgtgggacgtcctcggtcaagtcctcacctggcaccgtctgacgcagtacgaacacgtaactccgacctacgcctagtcgacctagtcggacctagtacaccgacgaacgtacgacccgacgggtaacgggttcctacggttctagaacgtagtaaaccttgactagtcgtaatcgcacggacctacgcgtacgggaacggggacgtactaccgtacgtcgtccttcgtacgacgtacctaccacggtcgtacggtcgggcgttacggacgtccgtccttccgactacgttaccgnttcccaccgtacgtccgttacccgtagtcgttggtaacgngtcgaaacgtccgttaagactttacgttacgtcggtacgacgggttacgtcgggactcgttcgggacttaacgtcggtacggttaccgggtccggaacggttacggtaacccgttaagggtccttaaccgggtcgtaaccgggtacctaccggtacccggttcggttaccccg

SEQ ID NO: 213580 - DNA, 660 bp, Homo sapiens
  misc_feature: GYAE6OF02H25LH.34.59.F04.1.454.CMB.1.raw
  modified_base (307)..(307): a, c, t, g, unknown or other
  misc_feature (307)..(307): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatccacctacgccatcgcatggcatcagccaacacgccacgggaacgggttccctcgggttcttgatacgtaaacttgactagtgagtggcagccaanagtacggaacggggggacggtactacccgtaagtccgtcttcgtcgacggtcctaccgagtcgtcggtcgggactgacgccgtccctccctcgacttcactcccgtccgactccctacagtaccgtggacggtagtggacggtctacggtactttagtttagtcgtacggtaggtaccgggttcggggacctaacggtcggtaccttaggtttacggacgggtttccgggtacgggtaccgggtacggggttaaccgtaacgggttaccggtcccgggttaccggtacgggtaccgaacccgggtacccggaacgggttccccggtaccggtaccccccggttggttaccccg

SEQ ID NO: 213581 - DNA, 632 bp, Homo sapiens
  misc_feature: GYAE6OF02GKYFG.34.59.F04.1.454.CMB.1.raw
  modified_base (172)..(172): a, c, t, g, unknown or other
  misc_feature (172)..(172): n is a, c, g, or t
  modified_base (209)..(209): a, c, t, g, unknown or other
  misc_feature (209)..(209): n is a, c, g, or t
  modified_base (339)..(339): a, c, t, g, unknown or other
  misc_feature (339)..(339): n is a, c, g, or t
tcagtacacgtgatcacgaccggtgctcgatttagtacacacacttagggattggagtctgcaccatggcttggaccccactcctcttcctcaccctcctcctccactgcacaggtctctctcccagcctgtgctgactcaatcgccctctgtctctgccctccctgggacncctcggtcaagctcacctgcactctgagcagtgaacncatcacctagccatcgcatgcatcagcacagccacggaaggtcctcggtcttgactagaacttgacgagtgagtggcacgccgacagtaccggaaggggggaccggtacgtacccctaagtccgtcttcncgtacggctccgagcctcggcggggctcggacgccgtcctcccgtcacgtcctactccgtcccgtacgcccgttacccagttccgtaggaggacgttgacggtcttacggtacttaatttacgttccggtacgtaacgggtccggtacgggggtcctaacgtacgggattaaccggttccggtaagggttcgttccgggacgggtacgggaaccgtaacggttcgtaacccggttcggacgggttccgaacggtaccgaaccggtcccgtaccggacccccgttcggtacccg

SEQ ID NO: 213582 - DNA, 833 bp, Homo sapiens
  misc_feature: GYAE6OF02GL7O6.34.59.F04.1.454.CMB.1.raw
tcagtacacgtgatcacgaccggtgctcgatttagtacacacacttagggattggagtctgcaccatggcttggaccccactcctcttcctcaccctcctcctccactgcacaggtctctctcccagcctgtgctgactcatcgccctctgtctctcgccctcccgtgggacgtccgtcggtcaacgtcctcacctgcctactcgtaggagctagtacgaacacactccaacctaccgcctagtccgacagtcggactactcgaacgacaaacgaccgaccggaaccgggaacggttcccgttcgggttcttagagtaacgtaaacgttcggaactagggtaggtacgtacgggaccacgtacccgaacgtaacggtacggggaaacggggggaccggtaactaacccgtaacgtccggtaccttcggtacgaacgtccctacgtacgtacggtcgggtacgggtactacgggtaccgtcccgtcccgttaccctacgttaccgtacctaaccgtcccctaccgtaccgtcccctaagggtaccgtcggtacgggtacgacggtacggtacggtacgttacgtaaaccgtttgtttaacggttcggtaacgggtaccgggtcgggttacggggtaatcccgggtcggttaacggtttcggtaaacggggttcgggttaccggggttacgggtaacccggggggtacggttaaaccgggtaacgggtttcccgggttaaacccgggttcccgggtaacgggttacccgaacgggtacccgggttacccgggtccccggttaccccgggttcccccgggttacgttaacccccgg

SEQ ID NO: 213583 - DNA, 703 bp, Homo sapiens
  misc_feature: GYAE6OF02IXAA8.34.59.F04.1.454.CMB.1.raw
  modified_base (172)..(172): a, c, t, g, unknown or other
  misc_feature (172)..(172): n is a, c, g, or t
  modified_base (203)..(203): a, c, t, g, unknown or other
  misc_feature (203)..(203): n is a, c, g, or t
  modified_base (439)..(439): a, c, t, g, unknown or other
  misc_feature (439)..(439): n is a, c, g, or t
tcagtacacgtgatcacgaccggtgctcgatttagtacacacacttagggattggggtctgcaccatggcttggacccactcctcttcctcaccctcctcctccactgcacaggtctctcctccagcctgtgctgactcaatccgcctctgtctctcgccctccgtgggacnccgtcggtacaagtctccgactgctacgtcngaacgcagtagaaccactacgtccaaccctacgccctaagtccgactagtcggactactacggacaccaaacgaccgaccggaacggggtaacggttcccctttcgggtttccttaagaacgtaacgttaacttcggaacgtaggtcgagtccgggacaccgaccgaatacggtaacgggggaaaccggggtacgtactacccgtagtccttacgttccgacggtacgccgtacgngttcgtcggacgggtatcggactccgcccttaccgtctagtacctccgtactccgacgttaccgtcgtaccgtcgtagggaacgtacggtaccggcgttactaacgttaacgtttcgtttaagtcgtaaccggtgggtaaccgggtcggtaccgtagtacgtcgttagttcggtaggttcgggtaacggcggtacgtacgtacggtccggtaccgtcggttcggacgtaccgtacggcgtccgacgttacccgagttcctcccg

SEQ ID NO: 213584 - DNA, 784 bp, Homo sapiens
  misc_feature: GYAE6OF02IT723.34.59.F04.1.454.CMB.1.raw
  modified_base (132)..(132): a, c, t, g, unknown or other
  misc_feature (132)..(132): n is a, c, g, or t
  modified_base (210)..(210): a, c, t, g, unknown or other
  misc_feature (210)..(210): n is a, c, g, or t
tcagtacacgtgatcacgaccggtgctcgatttagtacacacacttagggattggagtctgcaccatggcttggaccccactcctcttcctcaccctcctcctccactgcacaggtctctctccagcctgtnctgaatcaatccgccctctgtctctcgaccctccgtgggcgtccgtcggtacaacgcctacacctcgacctacttcgngacgctaaggtacgaaacctactacctaccgaacccgttaccgacctaacgtccggactacgtacggactacttacgaaccgacaacgtacgaccggaaccgggttaacggttccgttcggtttacgttagtacgtaagtaacttcggaacgtgtagtagtcgacgtaccgaccagacggtaacggaacggggacgtacgttaccgtagttccgcttacgtcgacgtccgttaccgcgtcggtcggtacgggcttgaccgtccgtcctaccgtactcctacctacgttaccgtccgaccgttacccgtaccgttacggtcgttacgggaacgttcggaggttacccggttagtttaccggtttaaatttaccggttacgttacggacgtacgggttacggtaccgtacgtcgggtacgtccgttaaggtacggttcgggttcggtaacggggaccgtaaccggttaaccggttacggtttacccggacgggtttccccggacgggtaacccggtaccggaaccccggtttccgggtcccgttcccccggtttaccgggtccccgtttaacccgg

SEQ ID NO: 213585 - DNA, 785 bp, Homo sapiens
  misc_feature: GYAE6OF02JKL2F.34.59.F04.1.454.CMB.1.raw
  modified_base (149)..(149): a, c, t, g, unknown or other
  misc_feature (149)..(149): n is a, c, g, or t
tcagtacacgtgatcacgaccggtgctcgatttagtacacacacttagggattggagtctgcaccatggcttggaccccactcctcttcctcaccctcctcctccactgcacaggtctctctcccagcctgtgctgactcatcgccctntgtctctgccctccgtgggactccgtcggtacaagcctacacctgcctactcgaggacgcgtaggtacaaaccactactacccgtaccgtaccgacctaacgtccggataacggtcggaccacgtacacgaccaaccgtacggacccggtaacggggtaaccggtccctgggttacttagaggttaacgtaacgttcgaacgtggtacggtaacgtcggaccgacgtaccgaacgacggttaacgggaacggggggtaaccgtaccttaacccgtacgtaccgtcgttacctacggaccggtcctacctaggtccgtcggtggggactacggtaccgtacccggacccttccgaagtccgtactaccgtctaccggacctcccgtaacgtcgtcgggaagtaccggtgtacgggtccgttaacctcgggtaaactttttacgtaccgggtacgtaccgggtaggggttacccggttcgggaacttaacgggtccgtaacggtttccgttaacggtccgggggtttacggccgggttaccgggaaggttttaccggtaaaccgttccgggtacccggtggttaaccggccgttaacccggcggttacgccccggttacccggtccggttactacccg

SEQ ID NO: 213586 - DNA, 740 bp, Homo sapiens
  misc_feature: GYAE6OF02FE0IN.34.59.F04.1.454.CMB.1.raw
  modified_base (167)..(167): a, c, t, g, unknown or other
  misc_feature (167)..(167): n is a, c, g, or t
tcagtacacgtgatcacgaccggtgctcgatttagtacacacacttagggagttgggggagctctggggagtctgcaccatggcttggaccccactcctcttcctcaccctcctcctccactgcacagggtctctctcccagcctgtgactgactcaactcgccctntagtctctgccctccgtagggacgcctcggtacaacggcctaccacctggaccactcgtaggacgcgtagtacgaacctacatcctacctaacgccctaacgtcgacctagtacggctaactcgaacggccaaacgacggtcccggaaacggggtaacgggtttccttccgggtttacttagggtaactttaaccgggtaaacttacggaaccgtagtaggtaacgttcgggaacaccggtactaacggacgtaacgggggaaacggggtaccggtactaccggtactccggactttacgacgacggtctacgacggtccgtacggtcggggtactaggccgtccggtccttaccacgtaactccgtacctaccgtcccgtaccgtcccgtactacggtacgtacggaaggttacgacgggtacgtcgtaacgtagtttagtacgtgggtaccgtaacgggtcgggtacggactacggtgtaaccgttgtacggcgggttcgtaacggggacggtaaccgtaccgtaggttcccgacggttcggtaaggtccgacggtccggaaccggtcccg

SEQ ID NO: 213587 - DNA, 696 bp, Homo sapiens
  misc_feature: GYAE6OF02FZFD5.34.59.F04.1.454.CMB.1.raw
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
  modified_base (377)..(377): a, c, t, g, unknown or other
  misc_feature (377)..(377): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatccgccctctgtctctcgccctcccgtgggacgtcctcggtacaagcctccacctgccactctggagcagtgaacacatcacctacgccatcgcatggcancagcaacacgccgaacggtaacggtccgttgttcgtagactaagtaacttgactaggtagatcgganacgccagagtacggggaacggggacggtacttacccgtaagccgtcttaccgacgacgtcctacgngtacgtcgggtcggtacgtcggacgtccgtacccttcccgtaccaagtcctaacttccctaccgacgtccccgttactcgttacgtacgggtagaccgttggccttagcttaaacgtttactaagttcgtaccgtaggtaccgggtggaccgttcggtaccggtacgttacggtttacggagggtttcgggtaccggggggtaccgggtaacgggacggttacggtttaccccgggaccgtttaccggggtacgtccggaaccggacccgttaccgggcccctttacccccgggccccggtttagaacccccgttcccg

SEQ ID NO: 213588 - DNA, 912 bp, Homo sapiens
  misc_feature: GYAE6OF02GEGBB.34.59.F04.1.454.CMB.1.raw
tcagtacacgtgatcacgaccggtgctcgatttagtacacacacttagggattggagtctgcaccatggcttggaccccactcctctcctcaccctcctcctccactgcacaggtctctcctcccagcctgtgctgactcaatccgcctctgtctctcgccctcccgtgggacgtcccgtcggtacgaacgtctacgaccctcggcctacctctaggacgccgtaagtacgaaacctactactccctaaccaaccgtacctacgtaccgaccgtagtacgggtactaacgtccgtaacgaaccaaacgaccggtacccgggaaaccgggtaccggggttacccgtttcgggttttaccgttaacggtaacttaacgggttaaaaccgttaccgggtaaacgtacgggttaaggtacgttcggaacccgtaaacggaccccgtaaacggtaaccgggttaaacggggggtaaaccggggggtaaccggggttacccttaaaccccggttaagttcccgttccgtttacccgacggtaccgtccccggtaacgtaccggtacttaccgggggtcgggacgtcgtacccgtcgtccccgtaccgtacgtccgtttaaccgtaccgttaccaacccgttcccgtaacccctcgttaacggtacccggtaggaacggttcggtacggtaccgttactttaacgtaaacggtttactttaaccggttggtaaaccggggaggttaccggggtcgggtaaacgttcccgggtaagtttaccgttaccggtaggggttcgggttaaccgggttccggggaccgggtaaccgggtacggttacgggtacccgttaccgggtccggtaaccggtcttaacccgggcgttaccgcccgtttacccgcccggttaccggtaccc

SEQ ID NO: 213589 - DNA, 828 bp, Homo sapiens
  misc_feature: GYAE6OF02FL1K5.34.59.F04.1.454.CMB.1.raw
  modified_base (646)..(646): a, c, t, g, unknown or other
  misc_feature (646)..(646): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtgctgactcaatccgccctctgtctctgccctcccgtggggacgccctcggtacaagcctcacctgccactctgagcaagtcgaaacacatacccaacccgtacgccctatccgactagtcgggccactcgaacgacaaacgacggaccccgaaacggggtaaacggggttcccttacgggtttctttacggtaagtaacgtaaaaccgtttggaaaccgacggtttaggtaacgttcggaccaaccgaccctaacggtaacgttaacggggaaacgggggaaccgggtaacctttacccgtaaagtcccgtcctttaacgtcggtacggacccttaaccgaggttccccgttagggttcggggaccttacggacggtcccgtaccgtttcccttacgaccgtttctaaccgtttacccgtcccgacggtcccttaacccggtacgttaccgtggggtaaacagggttacgaacgtcggttactaaactttacggtttatttccgggttaaacncggggtaaccggttgggtacccgtaacggttccgacgttacgttcgggaagggtttcgggtaccggtacggggaagggttacccctaaaggggtttaccgtaacccgggttcggtaaccgggtaacccgtaccgggtacccggtacccgggacgtttaccccccggcccgtttaggtccccg

SEQ ID NO: 213590 - DNA, 742 bp, Homo sapiens
  misc_feature: GYAE6OF02F3K51.34.59.F04.1.454.CMB.1.raw
  modified_base (166)..(166): a, c, t, g, unknown or other
  misc_feature (166)..(166): n is a, c, g, or t
  modified_base (219)..(219): a, c, t, g, unknown or other
  misc_feature (219)..(219): n is a, c, g, or t
tcagtacacgtgatcacgaccggtgctcgatttagtacacacacttagggattgggggagctctgggagtctgcaccatggcttggaccccactcctcttcctcaccctctcctccactgcacagggtctctactcccagcctgtcgctgacctcaatccgccctntcgtctactgcccttcccgagggacgcctcggtcaacgctcactgccactccngtacgcagtagaacctcaactcgaacctcgacctatcgcagtcggcactcacgacctaacgacgacccgaaacgggtacggtccgttcggttccgttagaattacggaaaccgttggaaccgtagtggtaatggacgacgtacacgacgtacggaacggggacgtacctacctaagtccgtcgttacacggacgctaccgtagccgtcggtacggtccgtaaggcgtccgtacccgtacctacgtaactaccggtaccgttaccgtacccgacgttaccccgtcgtaacggttccgagggtaaaccggtcgtagggtaaacgtccgttaacggtacctttaagttaaccgtttcggaccgtacgggttacccggtaggggtaaccacgggttctaccggtgtttacgggtacgggtccggttacggggaaccgggttaaccgggttaacccggtaacggtttaccgggtaccccgttacgggtaccggaccggtaacccgggttaccccggaagtccccccgg

SEQ ID NO: 213591 - DNA, 803 bp, Homo sapiens
  misc_feature: GYAE6OF02IDSTH.34.59.F04.1.454.CMB.1.raw
  modified_base (153)..(153): a, c, t, g, unknown or other
  misc_feature (153)..(153): n is a, c, g, or t
tcagtacacgtgatcacgaccggtgctcgatttagtacacacacttagggattgggggtctgcaccatggcttggaccccactcctcttcctcacccctcctcctccactgcacgagggtctctctcccagctgtgctgactcaatccgcctntgtctctcgtcctccgtgggacgtccgtcggtacaacgctaccacctgactacttctagacgaccgagtaacgaaccaactactaccaccgtaccgacctacgtccgactacgtcggacacgtacgaacgacaaaccgacgacccggtaacggggtaacgggttccgttaccggttacttacggtaagtaacggtaaacgttacggaagtagtacggtacgtacggacacgtacaacgaacggtaacggggaaacgggggtaccgacttaacccgtaagttccgttacgttaccgaacggtcgtacgtaccggtaggtcctacggggttcgggaccgtacgggaaaccgtcccggtacctaccgtactaacgtacctaccgtaccgtaccgtaccgtacccgtacgtaacgtacgtacggtaagtacggtacgtacggtacgtacgttacgttacgttacgttacgacggtacggtacgggtacggtacgtacgtacgtacgtagtacggtacggtacgggtacgggtacgggtacgggtaaccggttaacggttacggtaccgggttaccggtaccggtaccggtaacccggaaccggtaccggtaccggttacccggtacccggttcccggtaaaaaaccgttcccgg

SEQ ID NO: 213592 - DNA, 855 bp, Homo sapiens
  misc_feature: GYAE6OF02IRWZC.34.59.F04.1.454.CMB.1.raw
tcagtacacgtgatcacgaccggtgctcgatttagtacacacacttagggattgggggagctctggggagtctgcaccatggcttggaccccactcctcttcctcaccctcctcctccactgcacagggtctctctccagcctgtcgctgactcaactccgccctctcgtctctcgccctccgtgggcgtccgtcggtacaacgcctccaccgtcgactacctcgtagagcacgtacgaacacactcctaacccgtacgacctacgtccgacgtagttcggactactaaccgaacgaccgaacgaccggtaaccggtaacggggttaaccgggttccggttaccggtttacgttacggaacgttaacggttaaaccgtttacggaacgttaagggttacggacgttcgggaaccgtaaccgtaaccgaaccggtaacgggtaaccgggggaaccggggggtaaccgttaaccgtacccggttaaaccggttcccgttaccgttaccgtaccggtaccgtaccggtccgtacggtcgtcgggtacgggtccgacgggtaccgtcccgtacccgttccctaacgttcctaccgttacctccgtaacccggtcctacccgtaccgtacgtaccggtacggtacggttaccggtacgtacggtacttaacgttaacgtttacgttaacgttcggtacgacgggtaccggggttaacggcggtcgttacggtaccgttacgggttcggttacgggttccggggtaacgggtccggggtaacgggttaaccgttacgggtaccggttccgggttaacggtacccgggtaacgtaccccggtaccggtacccggttccccgg

SEQ ID NO: 213593 - DNA, 765 bp, Homo sapiens
  misc_feature: GYAE6OF02JNESQ.34.59.F04.1.454.CMB.1.raw
tcagtacacgtgatcacgaccggtgctcgatttagtacacacacttagggattggggggagctctgggggagtctggcaccatggcttggaccccactcctcttcctcaccctcctcctccactgcacgaggtctcctctcccagtcctgtgctcgactacactccgcccttctgtctcctcgcctccgtggactccgtcggtcacgtcctcaccgtcgctactcgagtacgacgagtacaaacacgtactacctaaccgtaccgacctacgtactacgacgtacgcctaacgtacaacggaacctaacgaaccggtaccgggaaaccggggttccggttacccggtttacggttaccgttaacggtaacgtaaccggttaaacgtacggtaacgtacgggtacgacggttaccggaactacctacggactacggggaacggggtaaggggtacctaccgtacgtacgtcgtacctcgtacggtcgtacctcgtcgtcgtacggtacgggcctacggtccgtcccggtaccgtcctacgtaccgtaccgtaaccgttcccgtaccggtaccttcccgtacgtccgttcggaacggtacgtacgtacggtacgtaccgtcgttacgttcgtacggttacggcgtacggacgggtcgtcgtagttccgagttaggtcgtagggtcgggaaacggtcgggtaacggtacggttaccgtacgggtaccggttacggccgggtaaccgtcggtaccggtaccgtacccgg

SEQ ID NO: 213594 - DNA, 760 bp, Homo sapiens
  misc_feature: GYAE6OF02F38I2.34.59.F04.1.454.CMB.1.raw
  modified_base (151)..(151): a, c, t, g, unknown or other
  misc_feature (151)..(151): n is a, c, g, or t
tcagtacacgtgatcacgaccggtgctcgatttagtacacacacttagggattggggtctgcaccatggcttggaccccactcctcttcctcaccctcctcctccactgcacagggtctctctcccagcctgtgctgactcaatcgccctntgtctctgcccttccctggggacgcctcgggtcaagcctcacctgccactctgagcagtgaacacatccacctacgccatccgcagtggcatcagaccaacgacgccgaacgggtaacgggtccttcgggtttcttaggataggaaactttgacagtgagtgggctacggaccaacgtacgtacggtaaacgggggggacggtaactacccgttaaagtcgtaccgttcctcgaacggtcctccagtcgtcggtagggctgggaacgtccggtcccttcccgactacttaccgacttccgtacccgaaccggtcccttaccgtaggttacccgtagggtaacggtacgttcggaacgggttaccttacggtaacctttaagtttacgttaaccggttcgaacgggttaccggggttacggggtaccgtaaccggttcggtaccgtttaacgtttcggacggggtttaccgggttcccgggggtacggtacgggggtaaccccgtttaagggtttccccgggtaaccggttcccgggttagggtaccccgtaaccggacccgttacggggtccccttccccggtccccccggtttagccgttaacccccg

SEQ ID NO: 213595 - DNA, 711 bp, Homo sapiens
  misc_feature: GYAE6OF02F742Q.34.59.F04.1.454.CMB.1.raw
tcagtacacgtgatcacgaccggtgctcgatttagtacacacacttagggattggagtctgcaccatggcttggaccccactcctcttcctcaccctcctcctccactacacagggtctctctcccagcctgtgctgactcaatcgccctctgtctctgccctcccgtgggacgcctcggcaagctcacctgcactctgagcagtgaacacatccacctacgcccatcgcatggaccagtcacgcaacacgccgaacgggaagggtcctcggttccttgatagaacttgacagtgatggcagccacagtacggaaagggggtacggtactcccttaaatccgtacttctacgacggtccttcccgacgtccgttccgggtagggggccttagggaccggtcccggtcccttaccccgttcgaactccgtaaccttcccgtacccgacggttccccttacccgtaggtacctacgggaacggtagtacgggtacggttcctaagttacctttaagttacgttcggtacgtacgggtcggtcggggacctaccggttaggaccgttagttccggtaggggtttaggttaccggggcgggttaaccggaccggttaaacggttccgggaaccggtttccccggtggggttacccaaccgggtcccgtaacgggtcccgttacccgggaaccccggttcggtaccgttaccccgg

SEQ ID NO: 213596 - DNA, 712 bp, Homo sapiens
  misc_feature: GYAE6OF02HJXV9.34.59.F04.1.454.CMB.1.raw
  modified_base (236)..(236): a, c, t, g, unknown or other
  misc_feature (236)..(236): n is a, c, g, or t
  modified_base (603)..(603): a, c, t, g, unknown or other
  misc_feature (603)..(603): n is a, c, g, or t
tcagtacacgtgatcacgaccggtgctcgatttagtacacacacttagggagttgggggagctctggggagtctgcaccatgacttggaccccactcctcttcctcaccctcctcctccactgccacagggtctctctcccagcctgtgctgacctcaatccgccctctgttctctcgccctcccgtgggcgtccgtacggtacaacgtcctccacctgacctaccttcgtacganaccgtagtacgaaccactactacctacccgtaccgaccactccgacagtcggacactacacgacaacgacgaccgacgggtacggtccgttcggttcgtagtatacgtaactacgactaggtagtagcgtacgacgtaccagacgtacgggaacggggaccgacgtaccgtagtccgtcttacgtacgacgtcctcgtacgtcgtcggtcgggtacgacggtaccgtcccgtcccgttaccctcgtaccgttcctacccgtacccgtcccgtacccgtcccgtaccgtcggttaccgtaggaacgtggtacggaacgttcgtaacgtacgtttaagttaccgttagtaccgtaggtcggtcgtaacncgtacgtacgtagtcggttaaggttcggggtacggacggttacgggtaacgttacggtacccggtcggtaccgggtaccgaccggtaccggaccgttaccggtcccggg

SEQ ID NO: 213597 - DNA, 722 bp, Homo sapiens
  misc_feature: GYAE6OF02GE2QJ.34.59.F04.1.454.CMB.1.raw
  modified_base (153)..(153): a, c, t, g, unknown or other
  misc_feature (153)..(153): n is a, c, g, or t
  modified_base (488)..(488): a, c, t, g, unknown or other
  misc_feature (488)..(488): n is a, c, g, or t
  modified_base (579)..(579): a, c, t, g, unknown or other
  misc_feature (579)..(579): n is a, c, g, or t
tcagtacacgtgatcacgaccggtgctcgatttagtacacacacttagggattggagtctgcaccatggcttggaccccactcctcttcctcaccctcctcctccactgcacagggtctctctcccagcctgtcgactgactcaatcgccctntgtctctgccctccctgggagcctcggtcaagctcacctgctactctagacgctaggtacgaaccacgtactccaacctaccggacccagtccgctaagtcggactactcacggaccaaacgacggaccccgaacggggtaaccgggtttcccgttccgggtttacgttaggaacttacggtaaaactttcggaacgtacggtaggacgtcggacgtacgacctacgtaacgtaccgggaaagggggtaccggactacccctaagtcgtcctttcgaccgtaggtccctacgacgtcgtacgggtggtacctagacgccggtacctaccccgtanactacgtacctccgtacgaccgtccctacgtcgtacgtggacgtcgaggtcgacttagtaaccttagtttgtacggtacaaggttccgggngtaccaggtccgtactacgttagggtggttaccgggtacggacggtaacggtacccggtaaggttacccggaaccgttccggtagttacccggaacggttcccgtaagggtccctaccccgggtccccgttacgtaaccccgg

SEQ ID NO: 213598 - DNA, 687 bp, Homo sapiens
  misc_feature: GYAE6OF02ITCM7.34.59.F04.1.454.CMB.1.raw
  modified_base (154)..(154): a, c, t, g, unknown or other
  misc_feature (154)..(154): n is a, c, g, or t
  modified_base (180)..(180): a, c, t, g, unknown or other
  misc_feature (180)..(180): n is a, c, g, or t
  modified_base (627)..(627): a, c, t, g, unknown or other
  misc_feature (627)..(627): n is a, c, g, or t
tcagtacacgtgatcacgaccggtgctcgatttagtacacacacttagggattggagtctgcaccatggcttggaccccactcctcttcctcaccctcctcctccactgcacaggtctctctcccagcctgtgctgactacaagtccgcccttntgtctcgtacgccctcccgtgggacncccgttcggtacaacgccttcgacctgcactcgtacgagcaggtacgaacactactaccgaccttacgctatccgcagtgctacgtacaacgacaacgacgaccggtaacgggtaaccggttccgttcgttaccgttagtaacgtaacggttaaccgttagaaccgttaaggttacgtaacgtacggaaccgtacgaacctaacgtacggtaacgggaacgggggtaacgtacctacgtaacgtcgtccgttcgtacgaggccgttacgacgtcccgttacggtcggggtactacggacgtccggtacccttacccgtataccgttaacaccgttccctacggactacccgttacacgtgttaacggagttcgaacgggctacgtattaagttcttacgtagcgtaggtcggtgtaactcgtagaccttagtcgagggttcgacggngaacgtcgttacgaccggcgttccgaggccacggtacgcgtccgtccgttaccgcgtacg

SEQ ID NO: 213599 - DNA, 404 bp, Homo sapiens
  misc_feature: GYAE6OF01EKCDB.29.27.C05.1.454.CMB.1.raw
  modified_base (403)..(404): a, c, t, g, unknown or other
  misc_feature (403)..(404): n is a, c, g, or t
tcagatagagtactcacgaccggtgctcgatttagacgcgatcgaagggctggtgtgggtctcacgtattaatagtgatgggactgacacaatctacgcggactccgtgaagggccgattcacccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttcccctggcgccctgctccaggagcacctccgagagcacagcggccctgggctgcctggtcaaggctactcctatgtatactctgagcgggctggcaaggcgcatagnn

SEQ ID NO: 213600 - DNA, 503 bp, Homo sapiens
  misc_feature: GYAE6OF01BL38R.29.27.C05.1.454.CMB.1.raw
tcagatagagtactcacgaccggtgctcgatttagacgcgatcgaagggtttggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgtcagcagcgtagcgactggcgtgggctcgactttcggcggagggaccaaggtagagatcgaaacgatgtggctgcaccatctgtcttctac

SEQ ID NO: 213601 - DNA, 409 bp, Homo sapiens
  misc_feature: GYAE6OF01ED0ND.29.27.C05.1.454.CMB.1.raw
  modified_base (407)..(409): a, c, t, g, unknown or other
  misc_feature (407)..(409): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagcacctccgagagcacagcggccctgggctgcctggtcaaggctacttcctctctcgactctgagcgggctggcaaggcgcatagnnn

SEQ ID NO: 213602 - DNA, 411 bp, Homo sapiens
  misc_feature: GYAE6OF01EA6CQ.29.27.C05.1.454.CMB.1.raw
  modified_base (409)..(411): a, c, t, g, unknown or other
  misc_feature (409)..(411): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaaggggacaatggtcaccgtctcttcagcctccaccaagggcccatcggtctcccctggcgccctgctccaggacgcaccctccgagagcacagcggccctggggctgcctggtcaaggctacttcctatgtatactctgagcgggctggcaaggcgcatagnnn

SEQ ID NO: 213603 - DNA, 413 bp, Homo sapiens
  misc_feature: GYAE6OF01DX5PT.29.27.C05.1.454.CMB.1.raw
  modified_base (404)..(404): a, c, t, g, unknown or other
  misc_feature (404)..(404): n is a, c, g, or t
  modified_base (410)..(413): a, c, t, g, unknown or other
  misc_feature (410)..(413): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatccggtcttccccctggcgccctgctccaggagcacctccgagagcacagcggccctgggctgcctggtcaaggactacttccgtatgtatactctgagcgggctggcaaggcncatagnnnn

SEQ ID NO: 213604 - DNA, 409 bp, Homo sapiens
  misc_feature: GYAE6OF01CKA9T.29.27.C05.1.454.CMB.1.raw
  modified_base (401)..(401): a, c, t, g, unknown or other
  misc_feature (401)..(401): n is a, c, g, or t
  modified_base (407)..(409): a, c, t, g, unknown or other
  misc_feature (407)..(409): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagcacctccgagagcacagcggccctgggctgcctggtcaaggctacttcctatgtatactctgagcgggctggcaaggcncatagnnn

SEQ ID NO: 213605 - DNA, 407 bp, Homo sapiens
  misc_feature: GYAE6OF01B26KU.29.27.C05.1.454.CMB.1.raw
  modified_base (407)..(407): a, c, t, g, unknown or other
  misc_feature (407)..(407): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagcacctccgagagcacagcggccctgggctgcctggtcaaggctacttcctatgtatactctgagcgggctggcaaggcgcatagn

SEQ ID NO: 213606 - DNA, 413 bp, Homo sapiens
  misc_feature: GYAE6OF01AUI3E.29.27.C05.1.454.CMB.1.raw
  modified_base (408)..(413): a, c, t, g, unknown or other
  misc_feature (408)..(413): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttcccctggcgccctgctccaggagcacctccgagagcacagcggccctggggctgcctggtcaaggactacttcctatgtatactctgagcgggctggcaaggcgcatagnnnnnn

SEQ ID NO: 213607 - DNA, 451 bp, Homo sapiens
  misc_feature: GYAE6OF01D365R.29.27.C05.1.454.CMB.1.raw
  modified_base (420)..(451): a, c, t, g, unknown or other
  misc_feature (420)..(451): n is a, c, g, or t
tcagatagagtactcacgaccggtgctcgatttagacgcgatcgaaggggctgggtgtgggtctcacgtattaatagtgatgggactgtacacaatctacgcggactccgtgaagggccgattcaccccctccagagacaacgccaagaacacactatatctgcaaatgaacagtctgagagccgaggacacggctgtctattactgtgcgaagaggtggctacgaatcatcggttttgatctctggggccaagggacaatggtcaccgtctcttcagcctccaccaagggcccatcggtcttccccctggcgccctgcctccaggagcacctccgagagcacaggcgccctgggctgcctggcaaggcctacgtcctcgtctcgactctgacgcgggctgggacaaggcgacagtacgnnnnnnnnnnnnnnnnnnnnnnnnnnnnnnnn

SEQ ID NO: 213608 - DNA, 412 bp, Homo sapiens
  misc_feature: GYAE6OF01ESEIR.29.27.C05.1.454.CMB.1.raw
  modified_base (407)..(412): a, c, t, g, unknown or other
  misc_feature (407)..(412): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaaggggacaatggtcaccgtctcttcagcctccaccaaggcccatcggtcttcccctggcgccctgctccaggagcacctccgagagcacagcggccctgggctgcctggtcaaggactacttcctatgtatactctgagcgggctggcaaggcgcatagnnnnnn

SEQ ID NO: 213609 - DNA, 423 bp, Homo sapiens
  misc_feature: GYAE6OF01DLVGO.29.27.C05.1.454.CMB.1.raw
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (409)..(409): a, c, t, g, unknown or other
  misc_feature (409)..(409): n is a, c, g, or t
  modified_base (416)..(423): a, c, t, g, unknown or other
  misc_feature (416)..(423): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctcagagacaacgccaagaacacactatatctgcaaaatgaacagtctgagagccgaggacacggctgtctattactgtgcaagaggtggctacaatcattggttttgatctctggggccaaagggacaatggtcaccgtctcttcagcctccaccaagggccccatcggtcttcccctggcnccctgctccagngcacctcgagagcacacgccggcccgtgggctgcccgtggtacaaggactacttcctatgtatactctgagcgggctggacaaggcncagtagnnnnnnnn

SEQ ID NO: 213610 - DNA, 416 bp, Homo sapiens
  misc_feature: GYAE6OF01DN15I.29.27.C05.1.454.CMB.1.raw
  modified_base (412)..(416): a, c, t, g, unknown or other
  misc_feature (412)..(416): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcattggttttgatctcgtggggccaagggacaatggtcaccgtctcttcagcctcaccaaggccccatcggtcttccccctggcgccctgctccaggagcacctccgagagcacagcggccctgggctgccctggtccaaggctaacttccctaatgtatactctgagcgggctggcaagcgcatagnnnnn

SEQ ID NO: 213611 - DNA, 541 bp, Homo sapiens
  misc_feature: GYAE6OF01CLPVO.29.27.C05.1.454.CMB.1.raw
  modified_base (202)..(202): a, c, t, g, unknown or other
  misc_feature (202)..(202): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (520)..(520): a, c, t, g, unknown or other
  misc_feature (520)..(520): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaacagaaacctggccaggctcccaggctcctcatctatgatgcataccaaaaggcctctggcatcccagcaggttcagtgcagtgggtcnggacagacttcactctacacatcagtncctaagngcctagaagtatttgactagtttatactgtacagctagcgtagcgtacgtggcggtggcctcgtacgtttcgggacgggtaggaacccgtaaagggtgaagtagtaacgaaacgtaagtggtcggcgtagcgtaacccnttcgtacgttcgttctacccg

SEQ ID NO: 213612 - DNA, 420 bp, Homo sapiens
  misc_feature: GYAE6OF01CPG4Y.29.27.C05.1.454.CMB.1.raw
  modified_base (412)..(420): a, c, t, g, unknown or other
  misc_feature (412)..(420): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcattggttttgattctcgtggggccaagggacaatggtcaccgtctcttcagcctccaccaagggcccatcggtcttccccctggccgccctgctccaggacgcaccctccgagagcacagcggccctgggctgcctggtcaaggctattcctatgtatactctgagcgggctggcaaggcgcatagnnnnnnnnn

SEQ ID NO: 213613 - DNA, 412 bp, Homo sapiens
  misc_feature: GYAE6OF01EDFZZ.29.27.C05.1.454.CMB.1.raw
  modified_base (322)..(322): a, c, t, g, unknown or other
  misc_feature (322)..(322): n is a, c, g, or t
  modified_base (407)..(412): a, c, t, g, unknown or other
  misc_feature (407)..(412): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggancacctccgagagcacagcggccctgggctgcctggtcaaggctacttcctctctcgactctgagcgggctggcaaggcgcatagnnnnnn

SEQ ID NO: 213614 - DNA, 411 bp, Homo sapiens
  misc_feature: GYAE6OF01CV1LJ.29.27.C05.1.454.CMB.1.raw
  modified_base (334)..(334): a, c, t, g, unknown or other
  misc_feature (334)..(334): n is a, c, g, or t
  modified_base (407)..(411): a, c, t, g, unknown or other
  misc_feature (407)..(411): n is a, c, g, or t
tcagatagagtactcacgaccggtgctcgatttagacgcgatcgaagggctggtgtgggtctcacgtattaatagtgatgggactgacacaatctacgcggactccgtgaagggccgattccaccccctccagagacaacgccaagaacacactatatctgcaaatgaacagtctgagagccgaggacacggctgtctattactgtgcaagaggtggctacaatcattggttttgatctcgtggggccaagggacaatggtcaccgtctcttcagcctcaccaagggcccatcggtcttccccctggcgccctgctccaggagcacctccgagngcacagcggccctgggctgcctggtcaaggactacttcctatgtatactctgagcgggctggcaagcgcatgnnnnn

SEQ ID NO: 213615 - DNA, 410 bp, Homo sapiens
  misc_feature: GYAE6OF01EUA60.29.27.C05.1.454.CMB.1.raw
  modified_base (321)..(321): a, c, t, g, unknown or other
  misc_feature (321)..(321): n is a, c, g, or t
  modified_base (400)..(400): a, c, t, g, unknown or other
  misc_feature (400)..(400): n is a, c, g, or t
  modified_base (406)..(410): a, c, t, g, unknown or other
  misc_feature (406)..(410): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaaggggacaatggtcaccgtctcttcagcctccaccaagggcccatcggtctccccctggcgccctgctccaggngcacctccgagagcacagcggccctgggctgcctggtcaaggactactcctatgtatactctgagcggctggcaaggcncatagnnnnn

SEQ ID NO: 213616 - DNA, 413 bp, Homo sapiens
  misc_feature: GYAE6OF01AM2ZN.29.27.C05.1.454.CMB.1.raw
  modified_base (403)..(403): a, c, t, g, unknown or other
  misc_feature (403)..(403): n is a, c, g, or t
  modified_base (408)..(413): a, c, t, g, unknown or other
  misc_feature (408)..(413): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggccccatcggtcttccccctggcgccctgctccaggagcacctccgagagcacagcggccctgggctgcctggtcaaggctacttcctctctcgactctgagcgggctggcaaggcgnatagnnnnnn

SEQ ID NO: 213617 - DNA, 484 bp, Homo sapiens
  misc_feature: GYAE6OF01DJW8V.29.27.C05.1.454.CMB.1.raw
  modified_base (346)..(346): a, c, t, g, unknown or other
  misc_feature (346)..(346): n is a, c, g, or t
  modified_base (462)..(484): a, c, t, g, unknown or other
  misc_feature (462)..(484): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccaccccctccagagacaacgccaagaacacactatatctgacaaatgaacagtctgagagccgaggacacggctgtctattactgtgcaagaggtgctacaatcattggttttgatctcgtggggaccaagggacaatggtcaccgttctcttcagccctaccgaccaacgggccccagttccgggtcctttcccccgtggccgccccgttgcctccgaggacnccaccctccgagacgcacgacggccggcccgtggggcctggcctggtaccaaggtaccttaccttccttattcgtaacttacgtctggacgccgggctgggacaaggcacagtagnnnnnnnnnnnnnnnnnnnnnnn

SEQ ID NO: 213618 - DNA, 409 bp, Homo sapiens
  misc_feature: GYAE6OF01EBT09.29.27.C05.1.454.CMB.1.raw
  modified_base (389)..(389): a, c, t, g, unknown or other
  misc_feature (389)..(389): n is a, c, g, or t
  modified_base (406)..(409): a, c, t, g, unknown or other
  misc_feature (406)..(409): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaaggcccatcggtcttccccctggcgccctgctccaggacgcacctcgagagcacagcggccctgggctgcctggtcaaggctattcctatgtatactctgagcgggntgggcaaggcgcatagnnnn

SEQ ID NO: 213619 - DNA, 822 bp, Homo sapiens
  misc_feature: GYAE6OF01E0VV5.29.27.C05.1.454.CMB.1.raw
  modified_base (107)..(107): a, c, t, g, unknown or other
  misc_feature (107)..(107): n is a, c, g, or t
  modified_base (119)..(119): a, c, t, g, unknown or other
  misc_feature (119)..(119): n is a, c, g, or t
  modified_base (127)..(127): a, c, t, g, unknown or other
  misc_feature (127)..(127): n is a, c, g, or t
  modified_base (134)..(134): a, c, t, g, unknown or other
  misc_feature (134)..(134): n is a, c, g, or t
  modified_base (136)..(136): a, c, t, g, unknown or other
  misc_feature (136)..(136): n is a, c, g, or t
tcagatagagtactcacgaccggtgctcgatttagacgcgatcgaagggtttgggggaggaactgctcagttaggacccagagggaaccatggaagccccagctcgntctctctcctcnactctcgngccacanancaccgacggaagtaagtgttgtacgacacgtacgttcctacgaccgacccctaccgttcgttttcgtttccgttcccgtaaccgggggaaaaggggaaaacgccgacccctttacccgtttcccttccggtcgacgggaccggaccgtacgtacgaaggttacggttggttcgacctaacctataagtaccgtcggttaaccggaaaccaacgaaaccgtaacggtccgaccggacgtcccctaccggacggtccctctactacttactagtagtacgtccgactaaccgtaaaaccggaaacggtcctacggtcgactacctaccgacgtacgtacgttacgacggtcgacggtgggtcggtcggtaacggacgacgttacctaccgtacttcacccaacgtatacggtaaggtacctaaccgtaacggtaccgtacgtaacgtaaagttttacgtttacgtagtttaacttttaactacggttcgtaacgacgtacgtacggtaccgtacggaccgtacgggtcgggtccgggtcggtaccgttacgttaccggggtttcggggaacggggtaaccggtaaaccggtaaggtaacggtacgaaacgttaaaccggaaacggttaacggtgggtacggtacgacgaacctaaccgttacttacggtttcttacccgtgttacccg

SEQ ID NO: 213620 - DNA, 425 bp, Homo sapiens
  misc_feature: GYAE6OF01CEVCQ.29.27.C05.1.454.CMB.1.raw
  modified_base (414)..(414): a, c, t, g, unknown or other
  misc_feature (414)..(414): n is a, c, g, or t
  modified_base (420)..(425): a, c, t, g, unknown or other
  misc_feature (420)..(425): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccaccccctccagagacaacgccaagaacacactatatctgcaaatgaacagtctgagagccgaggacacggctgtctattactgtgcaagaggtggctacaatcattggttttgatctctggggccaaggggacaatggtcaccgtctcttcagcctccaccaagggccccatccggtccttccccctggccgccctgcctccaggacgcacctccgagacgcacagccggccctggggctgcctggtcaaggactacttcctatgtatactctgagcgggctggcaaggcncatagnnnnnn

SEQ ID NO: 213621 - DNA, 516 bp, Homo sapiens
  misc_feature: GYAE6OF01DOP8T.29.27.C05.1.454.CMB.1.raw
  modified_base (155)..(155): a, c, t, g, unknown or other
  misc_feature (155)..(155): n is a, c, g, or t
  modified_base (185)..(185): a, c, t, g, unknown or other
  misc_feature (185)..(185): n is a, c, g, or t
  modified_base (485)..(485): a, c, t, g, unknown or other
  misc_feature (485)..(485): n is a, c, g, or t
  modified_base (487)..(516): a, c, t, g, unknown or other
  misc_feature (487)..(516): n is a, c, g, or t
tcagatagagtactcacgaccggtgctcgatttagacgcgatcgaaggggctgggtgtggggtctcacgtattaaatagtgatgggactgactacaatctacgcggactccgtgaagggccgattcaccccctccagagacaacgccaagaacanactatattctgcaaatgtaacagtctgagngccgaggacacggctgtctagttacgtgtgcaagaggtggctacaatcattggttttgattcgtcgtggggaccaagggacaaagtcggtaccaccgtcttacttcagccctacacccgaaagggccccagttcggtcctttcccccctgggcccgtccccgtgcctaccggagggacgcctacccgtccggagacgcaacgtacggccggcccgtgggaccttggcccttggtaccaaggtaccctacttccctctcgtcgactcgtggacgccgggctggacaggtccactatacgancnnnnnnnnnnnnnnnnnnnnnnnnnnnnnn

SEQ ID NO: 213622 - DNA, 466 bp, Homo sapiens
  misc_feature: GYAE6OF01DZ2MK.29.27.C05.1.454.CMB.1.raw
  modified_base (332)..(332): a, c, t, g, unknown or other
  misc_feature (332)..(332): n is a, c, g, or t
  modified_base (455)..(466): a, c, t, g, unknown or other
  misc_feature (455)..(466): n is a, c, g, or t
tcagatagagtactcacgaccggtgctcgatttagacgcgatcgaaggggctggtgtgggtctcacgtattaatagtgatgggactgacacaatctacgcggactccgtgaagggcccgattccaccccctccagagacaacgccaagaacacactatatctgcaaatgaacagtctgagagccgaggacacggctgtctattactgtgcaagaggtgctacaatcattggttttgatctcgtggggccaagggacaatggtcaccgtctcttcagcctccaccaagggccccatccggtccttccccctggccgccctgcctccgaggganccacctccggagcgacacgacgccggcccgtggggctcgccgttcggtacaaacgggtaccttaccgtttccctcttcctcgaccttctggacggccgggactgggaccaagggcgcaatagnnnnnnnnnnnn

SEQ ID NO: 213623 - DNA, 418 bp, Homo sapiens
  misc_feature: GYAE6OF01BRNZM.29.27.C05.1.454.CMB.1.raw
  modified_base (311)..(311): a, c, t, g, unknown or other
  misc_feature (311)..(311): n is a, c, g, or t
  modified_base (410)..(418): a, c, t, g, unknown or other
  misc_feature (410)..(418): n is a, c, g, or t
tcagatagagtactcacgaccggtgctcgatttagacgcgatcgaaggggctgggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtgctacaatcatggttttgatctctggggccaaaggggacaatggtcaccgtctcttcagcctccaccaagggccccatcggtcttccccctggcnccctgctccaggacgcacctccgagagcacagcggcctgggctgcctggtcaaggctacttcctatgtatactctgagcgggctggcaaggcgcatagnnnnnnnnn

SEQ ID NO: 213624 - DNA, 474 bp, Homo sapiens
  misc_feature: GYAE6OF01CT1DD.29.27.C05.1.454.CMB.1.raw
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (446)..(474): a, c, t, g, unknown or other
  misc_feature (446)..(474): n is a, c, g, or t
tcagatagagtactcacgaccggtgctcgatttagacgcgatcgaaggggctgggtgtgggtctcacgtattaatagtgatgggactgacacaatctacgcggactccgtgaagggccgattccaccccctcagagacaacgccaagaacacactatatctgcaaatgaacagtctgagagccgaggacacggctgtctattactgtgcaaggaggtgctacaatcattgggttttgatctcgtggggaccaagggactaagtggtccacgtctctnacgcctaccgacgaacggcccagtccggtccttcccccgnggcccncctcgcctacgacggacgccaccgtcgagacgcacgcgccggcctgggcctgccgtagacagtacttacttcaatcgtatactcgtggacgcgggtctagggacgtaacggcgacaagtacgnnnnnnnnnnnnnnnnnnnnnnnnnnnnn

SEQ ID NO: 213625 - DNA, 466 bp, Homo sapiens
  misc_feature: GYAE6OF01A5XSU.29.27.C05.1.454.CMB.1.raw
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (443)..(466): a, c, t, g, unknown or other
  misc_feature (443)..(466): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccaccccctccagagacaacgccaagaacacactatatctgacaaatgaacagtctgagagccgaggacacggctgtctattactgtgacaagaggtggctacaatcattggttttgatctcgtggggaccaagggacaagtggtcaccgtctcttcagcctccacaggccatcggtcctcccctggccncctgctcaggacnccacctccgagacncacacggccggcccgtggggctcggcccgtggtaccaaaggtaccttacttacctatgtaactactcgtaggacggcgggctggacgaaaggccgactaatagannnnnnnnnnnnnnnnnnnnnnnn

SEQ ID NO: 213626 - DNA, 449 bp, Homo sapiens
  misc_feature: GYAE6OF01A9LUV.29.27.C05.1.454.CMB.1.raw
  modified_base (330)..(330): a, c, t, g, unknown or other
  misc_feature (330)..(330): n is a, c, g, or t
  modified_base (435)..(449): a, c, t, g, unknown or other
  misc_feature (435)..(449): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaagggacaatggtcaccgtctcttcacgcctccaccaagggcccagtcggtccttcccccgtggccgccctgcctccaggacnccacctccgagagcacgacgccggcccgtgggctcgccgtggtcaacggtacttacgttcctatgtatactcgtgacggtcggctgggacgaaggcgacagtagnnnnnnnnnnnnnnn

SEQ ID NO: 213627 - DNA, 729 bp, Homo sapiens
  misc_feature: GYAE6OF01DJMFX.29.27.C05.1.454.CMB.1.raw
tcagatagagtactcacgaccggtgctcgatttagacgcgatcgaagggtttgggggtagggaactgctcagttaggacccagagggaaccatggaagccccagctcagcttctcttcctcctgctactctggctcccagatcgaccgacgaagtaagtgtgtgacacagtcctaccacgccctaccttgttcgttttcgtacggtaccgaggggaaacgaccgtccctaaccttcgtccgtaggccaggggcccaggtccgtaagtaagtcgttacggtaccacccgttacgaacttaacgaacccgttagggtaacccaaaacgaacgtaaacccgtacggggaccctaacgggaccttaccccgaaggtcccttaccctaccgtaactacctagtacgaacgtcggacctaacgtaccggaaaacgggtcctaccgtcggacctaacgttcccgagcctacggtcgtaggtcggtcgaggtcggtacgtggactagtacctcgactcctcgacctagtcgtaggtaccgacgtagtacgtaccgtagtaaagttactttgacttaagtttatactggtacagcgaggtcgagtcgtacgtacgtcggtcggactacgtggttacggacggtacggtaaccgtaaaggtacgtacggtaacgaccgtaaacgaccgttagggtccacgtcggaaccttcccgtactccgttacgtccttcgtacccg

SEQ ID NO: 213628 - DNA, 672 bp, Homo sapiens
  misc_feature: GYAE6OF01A5847.29.27.C05.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
tcagatagagtactcacgaccggtgctcgatttagacgcgatcgaagggtttgggggaggaactgctcagttaggacccagagggaaccatggaagccccagctcagctctcttcctcctgctactctggctcccagatgccacggagaagtgtgtcgacacgatcctccagcccacctcgtcttgtcctccgagggaaacncgcctaccttctcctgccacggccagtcagngtcgtcgacctacctagatacgctacgtaccaanacgtaaccgtcggaccagtccgaccgacggactccgtactactcctatacgancgtactaactaaccgaagtcctagtcgaactcgacccgagtcgagttaccaggtcgaacgtggtacgggacgttacgggactaccggtaacttcgaccctacgtaccaaccttagacgtaacgtaccggtacgagtaccgaacgttggtaactagtttacggacgttaatttaatccgngttacgacncgttaaggcccgtaagtcgtaaccgtgtaccggaacttcggtacggttacggtacggaccggaggttaaccgaagggtaagtaacctaggtaaacccggtaaagtcccggaaagggttcccgatacggacctacgtacgtttggtaccctaaggttctaccccg

SEQ ID NO: 213629 - DNA, 477 bp, Homo sapiens
  misc_feature: GYAE6OF01BBHTK.29.27.C05.1.454.CMB.1.raw
  modified_base (449)..(449): a, c, t, g, unknown or other
  misc_feature (449)..(449): n is a, c, g, or t
  modified_base (454)..(477): a, c, t, g, unknown or other
  misc_feature (454)..(477): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcacccccctccagagacaacgccaagaacacactatatctgcaaatgaacagtctgagagccgaggacacggctgtctattactgtgcaagaggtggctacaatcattggttttgatctcgtggggccaagggacaatggtcaccgtctcttcagcctccaccaacgggccccatccggtcctttcccccgtggccgtcccctgcctccaggacgccaccctccgagagcacagccggcccgtgggctgccgtggtcaaggacttacttcctatcgtactactcgtcggaggtccgggcgtcgggacgaacgggccgacgaacgtagngctgnnnnnnnnnnnnnnnnnnnnnnnn

SEQ ID NO: 213630 - DNA, 519 bp, Homo sapiens
  misc_feature: GYAE6OF01A8OU3.29.27.C05.1.454.CMB.1.raw
  modified_base (214)..(214): a, c, t, g, unknown or other
  misc_feature (214)..(214): n is a, c, g, or t
  modified_base (345)..(345): a, c, t, g, unknown or other
  misc_feature (345)..(345): n is a, c, g, or t
  modified_base (484)..(519): a, c, t, g, unknown or other
  misc_feature (484)..(519): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccacccccctccagagacaacgccaagaacacactatatctgcaaatgaacagtctgagagccgaggacacggctgtctattactgtgcaagnggtgctacaatcagttggttttgatctcgtggggaccaagggacaatggtcaccgtctcttcacgcctccaaccaacggggccccagtccggttccctttccccccgtggccgccctgcctccgagggacnccacccgtccgagacgcacaggcccggccgtggggcctcggcccgttgggtaccaaacggtaccttaccttccgtaattggtaaccttactcgtagggacggccggggtactcgggacgtaaagggcgtacaataggcnnnnnnnnnnnnnnnnnnnnnnnnnnnnnnnnnnnn

SEQ ID NO: 213631 - DNA, 570 bp, Homo sapiens
  misc_feature: GYAE6OF01BWXM7.29.27.C05.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
  modified_base (532)..(532): a, c, t, g, unknown or other
  misc_feature (532)..(532): n is a, c, g, or t
  modified_base (534)..(570): a, c, t, g, unknown or other
  misc_feature (534)..(570): n is a, c, g, or t
tcagatagagtactcacgaccggtgctcgatttagacgcgatcgaaggggctggtgtgggtctcacgtattaatagtgatgggactgacacaatctacgcggactccgtgaagggccattccaccccctcagagacaacgccaaagaacacactatatctgcaaaatgaacagtctgagagccgaggacacggtctgtctattacngtgcaaagnggtgctacaaatcattggttttgatctcgnggggaccaaaggggacaatggacaccgtntcttcacgcctccgaaccgaagggccccaagttccggtaccctttccccccgtggcccgtcccctggtccctccgaaggacgtccaaccccttaccggaagacgtaccaacgaacgggtccggtccccgttcgggggcttcggaccccttaggggttaacccaaaagggtaccctttaaccgtttaccctaagttacgttaactacttcgttggaacggtcggggacctgggactaaacgggccgactaataggaccntnnnnnnnnnnnnnnnnnnnnnnnnnnnnnnnnnnnnn

SEQ ID NO: 213632 - DNA, 537 bp, Homo sapiens
  misc_feature: GYAE6OF01D0T7A.29.27.C05.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (533)..(533): a, c, t, g, unknown or other
  misc_feature (533)..(533): n is a, c, g, or t
tcagatagagtactcacgaccggtgctcgatttagacgcgatcgaagggtttgggggaggaactgctcagttaggacccagagggaaccatgggaagccccagctcagcttctcttcctcctgctactctggctcccagatgccaccggagaaagtgtgttgacacagtctccagccaccctgtctttgctccaggggaanagccaccttctcctgcagggccagtcagagtgttggcacctacatagcctaggtaccaanagaaacctggccaggctccagctcctcatctatgatgcataccaaacgggcctcgtggcactcccagcctaggttcaggtggcgtaggtgggtcgtgggacaggtacttcgactctacaccatcagtacgcctagacgcctagtaagttatttgacttagtttacttactgtcagtctaggctagcgagtggcgtggtctacgtcgttcggcggagggaccgaagggtagacgagtacgaaacgtagtgtcggactgactacatcctgtctntacg

SEQ ID NO: 213633 - DNA, 648 bp, Homo sapiens
  misc_feature: GYAE6OF01BEXE9.29.27.C05.1.454.CMB.1.raw
  modified_base (538)..(538): a, c, t, g, unknown or other
  misc_feature (538)..(538): n is a, c, g, or t
  modified_base (550)..(550): a, c, t, g, unknown or other
  misc_feature (550)..(550): n is a, c, g, or t
tcagatagagtactcacgaccggtgctcgatttagacgcgatcgaagggctggtgtgggtctcacgtattaatagtgatgggactgacacaatctacgcggactccgtgaagggccgattcaccccctcagagacaacgccaagaacacactatatctgcaaatgaacagtctgagagccgaggacacggctgtctattactgtgcaagaggtggcctacaatcagttggtttttgattctcgtgggggccaaagggacaatcggtcaccgttctcttcacgtccctccaccaacgggccccattccggtcctttcccccgtggcccgtccctgcccttaccgaggacgcctacccgtccgagacgcaccgacggcccggccccgtggggctcggcccgtttagggtacccgaaaggttacccttacccgtttccgttaagttcggttaactaccgttaccgttacggacgggtccggggtcgtacgggtacccggaaacgggtccgtaaccgtaagtaacggtcgactcgtgtacgngagcgtacgcgngacggacgacgacgtagtacgtacgtcgtacgtcgtcgtacgtcgcgtcgtactacgtcgtacgagtacgtacgacgtacgtaccgtacgtcgtaccg

SEQ ID NO: 213634 - DNA, 541 bp, Homo sapiens
  misc_feature: GYAE6OF01CSMGJ.29.27.C05.1.454.CMB.1.raw
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (347)..(347): a, c, t, g, unknown or other
  misc_feature (347)..(347): n is a, c, g, or t
  modified_base (506)..(506): a, c, t, g, unknown or other
  misc_feature (506)..(506): n is a, c, g, or t
  modified_base (508)..(541): a, c, t, g, unknown or other
  misc_feature (508)..(541): n is a, c, g, or t
tcagatagagtactcacgaccggtgctcgatttagacgcgatcgaaggggctggtgtgggtctcacgtattaatagtgatgggactgacacaatctacgcggactccgtgaagggccattccaccccctcagagacaacgccaaagaacacactatatctgacaaaatgaaacngtctgagagccgagacacggctgtctattactgngacaaaggnggtcgctaacaatcaagttgggttttcattccgtcgtgggggaccaaaaggggacaagtgggtccaccgtctcttacgacgtccctccaaccgaacgggcccctagtccggtcccttcccccgtggcccnccctcgcctaccgaggacgaccacccgtcggaacgacgaccaacgacggtccggtccccgtggggctacggccgtacggtacgaaacggtacttacgtttcctaagtgtaactacttacgcggaacgccggggcgtacgggacaagggcactaagtagngnnnnnnnnnnnnnnnnnnnnnnnnnnnnnnnnnn

SEQ ID NO: 213635 - DNA, 645 bp, Homo sapiens
  misc_feature: GYAE6OF01DIB8J.29.27.C05.1.454.CMB.1.raw
  modified_base (244)..(244): a, c, t, g, unknown or other
  misc_feature (244)..(244): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
  modified_base (611)..(614): a, c, t, g, unknown or other
  misc_feature (611)..(614): n is a, c, g, or t
  modified_base (616)..(619): a, c, t, g, unknown or other
  misc_feature (616)..(619): n is a, c, g, or t
  modified_base (621)..(645): a, c, t, g, unknown or other
  misc_feature (621)..(645): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccaccccctccagagacaacgccaaagaacacactatatctgcaaatgaacagtctgagagccgagacacggctgtctattactgtgacaagaggtcggactaacaatctagttggtttttanattcgtcgtgggggaccaaaggggactaagttcggtctaacccggttcttacttcacgcccttaccaaccgaacggggccccacgttccggttcccctttccccccgtgggcccgtccccgtgtcccgttacccgaagggtaacgccccgtaacccgttacccgggaacgacggacccgaacctacgggcccggtccccggtggggcttacggcccgtttgggtaacccgaacgggtaaccctttaccgtttacctttaagtttcgttaaactttaccgttaccgttcgggtaacgggtcccggggtacgttaccgggaaccggtaaaccgggcccgtaacctaagggttaaacgccanaggcngannnngnnnngnnnnnnnnnnnnnnnnnnnnnnnnn

SEQ ID NO: 213636 - DNA, 615 bp, Homo sapiens
  misc_feature: GYAE6OF01B4RA8.29.27.C05.1.454.CMB.1.raw
  modified_base (196)..(196): a, c, t, g, unknown or other
  misc_feature (196)..(196): n is a, c, g, or t
  modified_base (216)..(216): a, c, t, g, unknown or other
  misc_feature (216)..(216): n is a, c, g, or t
  modified_base (579)..(615): a, c, t, g, unknown or other
  misc_feature (579)..(615): n is a, c, g, or t
tcagatagagtactcacgaccggtgctcgatttagacgcgatcgaaggggctggtgtgggtctcacgtattaatagtgatgggactgacacaatctacgcggactccgtgaagggccattccaccccctcagagacaacgccaagaacacactatatctgacaaatgaaacagtctgagacgccgaggacacggtntgtctattctgtgacaaggnggtcgactaacaatctagtttggttttgacttcgtcggtaggggaccaaaggggtactaagttcggcctaccgttcttcttacaccgccctaccaaccggtacggccctacgttcccggttcccctccccggtgcccctccgtgaccctccgaggaccgtcccacccgtcggaagacggtaccacggaccgggcccggtcccgtacggggtcctcggtacccggtttagggaaaacccgttaacggtaccctttacctttaccgtaagtttaccggtttaaaccttaccggttacgggtaccgggaccggggtaccgggtaccggtacggggaccgaaacccggttcgaaacgttagtagcgnnnnnnnnnnnnnnnnnnnnnnnnnnnnnnnnnnnnn

SEQ ID NO: 213637 - DNA, 847 bp, Homo sapiens
  misc_feature: GYAE6OF01D4YP8.29.27.C05.1.454.CMB.1.raw
  modified_base (202)..(202): a, c, t, g, unknown or other
  misc_feature (202)..(202): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaacgtgtgttgacacagtctccagccaccttgtctttgtctccgagggaancgccaccttctcctgcgaggccagtcaggtaggtgttggcctaacctacagtacgtcctacggtaacccaacgaacgtaaacccgtcggacccgaaggcccttaccccgaacgggtcccttccctaactaacttcccttaagtcgtaacgttcggacctaacgttaacccggtaaaaaccgggggtcctttaccggttacggaccgtaacccgtaccccgtaacggtaccccggttaacgggttccgaacgggtcgggtacgtacggggttcggggtacgtacggggaaccttaacggtaccctttacgtaccttaccgtacctaaccgtaacgtactaaccggttacggccgttaaacggaccgtaccgtaagttaaacggtttacgttttcggtaactttaaacgtttttacttacgtttacgttacgaacgtacgtacggtaacgggttacgtccggttacggttaacgggtcgggttcggttaccgttacggttttaccgggttccgggggaacggtaacggggtaaccgtaagggttaagaccggtaaacttaacccgggaaaacgttacggttgggtaccgacgttaccgggaaccctacccgttacttccggtttaccttccgttacctttaccccgg

SEQ ID NO: 213638 - DNA, 594 bp, Homo sapiens
  misc_feature: GYAE6OF01AH1B6.29.27.C05.1.454.CMB.1.raw
  modified_base (195)..(195): a, c, t, g, unknown or other
  misc_feature (195)..(195): n is a, c, g, or t
  modified_base (434)..(434): a, c, t, g, unknown or other
  misc_feature (434)..(434): n is a, c, g, or t
  modified_base (494)..(494): a, c, t, g, unknown or other
  misc_feature (494)..(494): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (558)..(559): a, c, t, g, unknown or other
  misc_feature (558)..(559): n is a, c, g, or t
  modified_base (561)..(561): a, c, t, g, unknown or other
  misc_feature (561)..(561): n is a, c, g, or t
  modified_base (564)..(565): a, c, t, g, unknown or other
  misc_feature (564)..(565): n is a, c, g, or t
  modified_base (567)..(568): a, c, t, g, unknown or other
  misc_feature (567)..(568): n is a, c, g, or t
  modified_base (570)..(572): a, c, t, g, unknown or other
  misc_feature (570)..(572): n is a, c, g, or t
  modified_base (574)..(575): a, c, t, g, unknown or other
  misc_feature (574)..(575): n is a, c, g, or t
  modified_base (577)..(578): a, c, t, g, unknown or other
  misc_feature (577)..(578): n is a, c, g, or t
  modified_base (580)..(584): a, c, t, g, unknown or other
  misc_feature (580)..(584): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
tcagatagagtactcacgaccggtgctcgatttagacgcgatcgaaggggctggtgtgggtctcacgtattaatagtgatgggactgacacaatctacgcggactcggtgaagggccattccaccccctcagacgacaacgccaagaaccacactatatctgacaaaatgaacagtctgagacgccgagtaccgnggtctgtctattactgtacgacaaggtaggtcggtacctaaactaagtcgtaagtttgggttttacgacttccggtcggtacgggggaaccgtaaagggtactaagtcggtaccgtaccgtcttcgtcaccgcctaccgaccgaacgtccaccgttccgttccctccccgtgccctccgtcgcctcgacgcgaccgtcccgtacgacgcaaccgtcgaccggtcccggccgtcggtccnggtacccgtaggtcggaaacgtcttcccgttactagttcgtatccgtagccccccccggnggtcggtcgtacgacggtaccggaccgacgtacgtaacgntacgntacngctcngtacncgcgnngntcnngnncnnncnngnncnnnnnacnncngngn

SEQ ID NO: 213639 - DNA, 568 bp, Homo sapiens
  misc_feature: GYAE6OF01EGKFQ.29.27.C05.1.454.CMB.1.raw
  modified_base (187)..(187): a, c, t, g, unknown or other
  misc_feature (187)..(187): n is a, c, g, or t
  modified_base (252)..(252): a, c, t, g, unknown or other
  misc_feature (252)..(252): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (535)..(568): a, c, t, g, unknown or other
  misc_feature (535)..(568): n is a, c, g, or t
tcagatagagtactcacgaccggtgctcgatttagacgcgatcgaagggggctggtgtgggtctcacgtattaatagtgatgggactgacacaatactacgcggactccggtgaaagggccgattccaccccctcagagacaaaccgccaaagaacacactatatctgcaaatgaacagtctgaagngccgaaggacacgggctgtctattactgtgcaaggaggtgctaacaatcgtaagtttggttttanacttccgtcggtagggggacccaaagggacaagttcggtaccaccgttctcttcacgcctccaaccgaaggccctagtcccggttccttcccccgnggccncccctgcctcgaggcgccacccgtcgagagacctacgacggtccggccccgtaggggccttcgcccggtttaggtaccgaaaggtccctttaccctttccctcgtacccttccggtaacctttcggtaggaaccgggccgggtcgtacgggaacccgtaaagggccgacgtaaggngcgngnnnnnnnnnnnnnnnnnnnnnnnnnnnnnnnnnn

SEQ ID NO: 213640 - DNA, 773 bp, Homo sapiens
  misc_feature: GYAE6OF01BT3XJ.29.27.C05.1.454.CMB.1.raw
  modified_base (281)..(281): a, c, t, g, unknown or other
  misc_feature (281)..(281): n is a, c, g, or t
tcagatagagtactcacgaccggtgctcgatttagacgcgatcgaagggtttgggggaggaactgctcagttaggacccagagggaaccatggaagccccagctcagcttctcttcctctgctactctggctcccagatgccaccggagaagtgtgttagacacagtctaccacgcccaccttgttctttcgtccgtaccggaaggggaaacgcgtcccttacctttctaccgtcgcgacggacctagtacgaggtaggttcggttcggacctaaccctanaacgtaccgtccggttaacgaaccaacggaacgaacccgtcggaccgtacggtccctaccgacgtcctacccttacgtacttactagtcgtagtactaaccgtaacgtaaaccgggaaccggtccgtacgtacggaccctaccgtaccccgacggtccgtaagggttaccgacgggtacgggtacgtacggggttcgggttaccgggaacgggttcaacgggttcccttaaccgccttacccgacctaactacgtagtaccgtacgtataccgtacggtactaggttacggtttacttgttaactttaggtttctttaacgccgttagacggtacggtaacggtcgtaccggcgggttcggacgggtacggtcggttaccctacgggttcgggtaccgggacgggtaccgaagttaggacggtagaaccgttaacggacttaggtcgccgacgtacgacgtaccgttattcccgttatcccgttcgtacccg

SEQ ID NO: 213641 - DNA, 563 bp, Homo sapiens
  misc_feature: GYAE6OF01C6HUG.29.27.C05.1.454.CMB.1.raw
  modified_base (216)..(216): a, c, t, g, unknown or other
  misc_feature (216)..(216): n is a, c, g, or t
  modified_base (531)..(563): a, c, t, g, unknown or other
  misc_feature (531)..(563): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccaccccctcagagacaacgccaaagaacacactatatctgacaaaatgaaacagtctgagagccgaggacacggctgtctattactgtgcaagnggtgctaacaatctagttggttttgattcctcggtagggggaccaaaggggacaagtggtccaccggtctcttcacgtccctaccgaaccgaaccgggcccagttcccggttccctttccccccgcggcccgccccgttcgcccgtccgaacggaccgccacccgtccggaagacgcaaccgacggcccggccccgtaggggcctcggtccgtcggtaccgaacggtacctttaccgtcccttaagtcttaacgtcgttactaggaccgggtccggggtctcgggaaccggtaagggccgtaacgtagtaagcgnnnnnnnnnnnnnnnnnnnnnnnnnnnnnnnnn

SEQ ID NO: 213642 - DNA, 654 bp, Homo sapiens
  misc_feature: GYAE6OF01C8GEV.29.27.C05.1.454.CMB.1.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (364)..(364): a, c, t, g, unknown or other
  misc_feature (364)..(364): n is a, c, g, or t
  modified_base (619)..(619): a, c, t, g, unknown or other
  misc_feature (619)..(619): n is a, c, g, or t
  modified_base (625)..(654): a, c, t, g, unknown or other
  misc_feature (625)..(654): n is a, c, g, or t
tcagatagagtactcacgaccggtgctcgatttagacgcgatcgaagggggctgggtgtgggtctcacgtattaatagtgatgggatgacacaatctacgcggactccgtgaagggccattccaccccctcagagacaacgccaagaaccacactatatctgacaaatgaacagtctgagacgccgaggacacggctgtctattactgtgacaaggnggtgacctaanaatcgtagtttggttttacattcgtacggtacgggggaccgtaaagggactaagtcggtaccaccgttctccttacaccgtccctacccgaaccgaaccgggtccctacggtttcccggttcccctttcccccggnggaccccgtcccgtgccctaccggaggaccgaccccgaacccgtaccggaacgacgacctaccggaccgggtacccggtcccgggtaacgggcccgttaccggtcccggtttcgggtaaaacggtaaccggtttaaccccttttaccggtttaccttacgtttaacgttaacccttaccggttcgggtaacgggccgggggtacccgggttacgcggggaaaccgaacggggtcccaagttaagacgcaatcgantgctannnnnnnnnnnnnnnnnnnnnnnnnnnnnn

SEQ ID NO: 213643 - DNA, 592 bp, Homo sapiens
  misc_feature: GYAE6OF01BHYRT.29.27.C05.1.454.CMB.1.raw
  modified_base (202)..(202): a, c, t, g, unknown or other
  misc_feature (202)..(202): n is a, c, g, or t
  modified_base (452)..(452): a, c, t, g, unknown or other
  misc_feature (452)..(452): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggaaccaacaagaaacctggccaggcctcccaggctcctcactctatgatgcataccgaaaacgggccctcgtcggcactcccacgccgacggttcaggtcggcgtaggttcgggtcgtgggactaggtacttcactctacaccatccacgtagccgtagacgcgtagtaacgttatttgtcttaagttttacttacgttntacgagtcgtagtcgtagtccgacgtggcggttggcccttgtcgtttcgggcgggtacggaccggaaggtacggagtacgtaaccgaaacggtagtgggtggtcgtagccgtacgtactcgttcgttccttcggttaccc

SEQ ID NO: 213644 - DNA, 573 bp, Homo sapiens
  misc_feature: GYAE6OF01BBU6K.29.27.C05.1.454.CMB.1.raw
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (416)..(416): a, c, t, g, unknown or other
  misc_feature (416)..(416): n is a, c, g, or t
  modified_base (541)..(541): a, c, t, g, unknown or other
  misc_feature (541)..(541): n is a, c, g, or t
  modified_base (544)..(551): a, c, t, g, unknown or other
  misc_feature (544)..(551): n is a, c, g, or t
  modified_base (553)..(573): a, c, t, g, unknown or other
  misc_feature (553)..(573): n is a, c, g, or t
tcagatagagtactcacgaccggtgctcgatttagacgcgatcgaaggggctggtgtgggtctcacgttattaatagtgagtgggactgacacaatctacgcggactccgtggaagggccattccaccccctcaagagacaacgccaaagaacacactatatctgacaaaatgaacagtctgaggngaccgaggacacggctgttctattacngtgacgaaggtggtgactaanaacgttctagtttgggttttanactccgtcggtacgggggacaaaggggataagttcggtcctaccggttctctacgacggccctccaaccggacgggaccctacgttcccggttcccttcccccgcgggcccgtcccctacgtcccgtacgtacggaaccgcccaacccgtcggaagaccncgacgtaccggcccggtcccgtcggggtctaccggcgtacgtaccggtaacggtacccttacgttacttagtagtaccttacgcgtggacgggtggtccggagacggtacgggcacgtagatgancgnnnnnnnnannnnnnnnnnnnnnnnnnnnn

SEQ ID NO: 213645 - DNA, 409 bp, Homo sapiens
  misc_feature: GYAE6OF02GDWET.29.27.C05.1.454.CMB.1.raw
  modified_base (406)..(409): a, c, t, g, unknown or other
  misc_feature (406)..(409): n is a, c, g, or t
tcagatagagtactcacgaccggtgctcgatttagacgcgatcgaagggctggtgtgggtctcacgtattaatagtgatgggactgacacaatctacgcggactccgtgaagggccgattcacccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnn

SEQ ID NO: 213646 - DNA, 507 bp, Homo sapiens
  misc_feature: GYAE6OF02FYGF4.29.27.C05.1.454.CMB.1.raw
  modified_base (261)..(261): a, c, t, g, unknown or other
  misc_feature (261)..(261): n is a, c, g, or t
  modified_base (504)..(504): a, c, t, g, unknown or other
  misc_feature (504)..(504): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaanagaaacctggccaggctcccaggctcctcatctatgatgcatccaaaagggcctctggcatcccagccaggttcagtggcagtgggtctgggacagacttcactctcaccatcagtagcctagagcctgaagattttgctagtttatactgttcagcagcgtagcgactggcgtgggctcgactttcgggcggagggaccaaggtagagatacgaaacgaactgtggctgcacatctgtcttntac

SEQ ID NO: 213647 - DNA, 531 bp, Homo sapiens
  misc_feature: GYAE6OF02GP58W.29.27.C05.1.454.CMB.1.raw
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagacgcctagaagtattttgactagttttatactgttacagtcagcgtagcgacgtggcggtgggctcgtacgtttcgggcggaggaccgaagtagagagtacgaaacgtaacgtggtaggcgtagcacgtatcgtcgtccttctaccg

SEQ ID NO: 213648 - DNA, 523 bp, Homo sapiens
  misc_feature: GYAE6OF02GP5QE.29.27.C05.1.454.CMB.1.raw
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaagggcctctggcatcccagccaggtcagtggcagtggtctgggacagacttcactctcaccatcagtagcctagacgcctgaagtattttgctagtttattacttgtacagcagcgtagcgacgtggcgtgggctcgtacgtttcgggcggagggaccaagggtagagtagtacgaaacgaactggtagcgtgcgaccagtctcgttcttctacc

SEQ ID NO: 213649 - DNA, 534 bp, Homo sapiens
  misc_feature: GYAE6OF02IT764.29.27.C05.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (397)..(397): a, c, t, g, unknown or other
  misc_feature (397)..(397): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccgaggggaaangccaccttctcctgcagggccagtcagagtgttggcacctacatagcctggtaccaanagaaacctggccaggctcccaggctcctcatctatgatgcatccaaaagggcctctggcatcccagccaggttcagtggcaggtgggtctgggacagacttcactctcaccatcagtagcctagagcctagaagtnttttagctagtttattacgtgtcagcagtcgtagcgactgggcgtgggctcgtacgtttcggcgggaggtaacccgaagggtacgagatacgaaacgtaactaggtggactgacaccgtatcgtgttcttctaaccg

SEQ ID NO: 213650 - DNA, 414 bp, Homo sapiens
  misc_feature: GYAE6OF02FE3NA.29.27.C05.1.454.CMB.1.raw
  modified_base (404)..(404): a, c, t, g, unknown or other
  misc_feature (404)..(404): n is a, c, g, or t
  modified_base (410)..(414): a, c, t, g, unknown or other
  misc_feature (410)..(414): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggccccatcggtcttccccctggccgccctgctccaggagcacctccgagagcacagcggccctgggctgcctggtcaaggactacttcctatgtatactctgagcgggctggcaaggcncatagnnnnn

SEQ ID NO: 213651 - DNA, 416 bp, Homo sapiens
  misc_feature: GYAE6OF02GARJT.29.27.C05.1.454.CMB.1.raw
  modified_base (410)..(416): a, c, t, g, unknown or other
  misc_feature (410)..(416): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggccccatcggtcttccccctggcgccctgctccaggagcacctccgagagcacagcggccctggggctgcctggtcaaggactacttcctatgtatactctgagcgggctggcaaggcgcatagnnnnnnn

SEQ ID NO: 213652 - DNA, 525 bp, Homo sapiens
  misc_feature: GYAE6OF02IXK36.29.27.C05.1.454.CMB.1.raw
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (500)..(500): a, c, t, g, unknown or other
  misc_feature (500)..(500): n is a, c, g, or t
  modified_base (513)..(513): a, c, t, g, unknown or other
  misc_feature (513)..(513): n is a, c, g, or t
  modified_base (520)..(520): a, c, t, g, unknown or other
  misc_feature (520)..(520): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaaggcctctggcatcccagccaggttcagtggcaggtgggtctgggacagacttcactcncaccatcagtancctagacgcctgaatatttgctagtttattactgtcagcagcgttagcgtacgtggcggtggctctacgtttcgggcggtacggaccgaagggtacgagatacgaaacggtaactggtgtntcgacacgatcgngtccttntaccg

SEQ ID NO: 213653 - DNA, 519 bp, Homo sapiens
  misc_feature: GYAE6OF02GK0KC.29.27.C05.1.454.CMB.1.raw
  modified_base (202)..(202): a, c, t, g, unknown or other
  misc_feature (202)..(202): n is a, c, g, or t
  modified_base (516)..(516): a, c, t, g, unknown or other
  misc_feature (516)..(516): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaanagccaccttctcctgcagggccagtcagagtgttggcacctacatagcctggtaccaacagaaacctggccaggctcccaggctcctcatcctatgatgcatccaaaagggcctactggcatcccagccaggttcagtggcagtgggtctgggacagacttcactctcaccatcagtagcctagagcctgaagattttgctagtttattactgttcagcagcgtagcgactggcgtgggctcgactttcgggcggagggaccaagggtagagatacgaaacggtaactggtagctggacaccatcgtgttcttntac

SEQ ID NO: 213654 - DNA, 409 bp, Homo sapiens
  misc_feature: GYAE6OF02GY5YK.29.27.C05.1.454.CMB.1.raw
  modified_base (403)..(409): a, c, t, g, unknown or other
  misc_feature (403)..(409): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtctcccctgcgccctgctccaggagcacctccgagagcacagcggccctgggctgcctggtcaaggctacttcctatgtatactctgagcgggctggcaaggcgcatgnnnnnnn

SEQ ID NO: 213655 - DNA, 517 bp, Homo sapiens
  misc_feature: GYAE6OF02IPBG9.29.27.C05.1.454.CMB.1.raw
  modified_base (514)..(514): a, c, t, g, unknown or other
  misc_feature (514)..(514): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctccctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgttcagcagcgtagcgactggcgtgggcttcgtacgtttcggcgggtaggaaccgaaggtagagatacgaaacggaactgtggctgcaccatctagtcttntac

SEQ ID NO: 213656 - DNA, 424 bp, Homo sapiens
  misc_feature: GYAE6OF02IXN0J.29.27.C05.1.454.CMB.1.raw
  modified_base (323)..(323): a, c, t, g, unknown or other
  misc_feature (323)..(323): n is a, c, g, or t
  modified_base (411)..(424): a, c, t, g, unknown or other
  misc_feature (411)..(424): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatgggttttgatctctggggccaagggacaatggtcaccgtctcttcagcctccaccaagggcccatcggtcttccccctggcgccctgctccaggancacctccgagagcacacgcggccctgggctgcctggtcaaggactacttctatgtactactctgagcgggctggcaaggcgcagtagnnnnnnnnnnnnnn

SEQ ID NO: 213657 - DNA, 417 bp, Homo sapiens
  misc_feature: GYAE6OF02I4N5W.29.27.C05.1.454.CMB.1.raw
  modified_base (404)..(404): a, c, t, g, unknown or other
  misc_feature (404)..(404): n is a, c, g, or t
  modified_base (410)..(417): a, c, t, g, unknown or other
  misc_feature (410)..(417): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagccacctccgagagcacagccggccctgggctgcctggtcaaggactacttcctatgtatactctgagcgggctggcaaggcncatagnnnnnnnn

SEQ ID NO: 213658 - DNA, 459 bp, Homo sapiens
  misc_feature: GYAE6OF02F9IDB.29.27.C05.1.454.CMB.1.raw
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (422)..(427): a, c, t, g, unknown or other
  misc_feature (422)..(427): n is a, c, g, or t
  modified_base (429)..(459): a, c, t, g, unknown or other
  misc_feature (429)..(459): n is a, c, g, or t
tcagatagagtactcacgaccggtgctcgatttagacgcgatcgaagggggctggtgtgggtctcacgtattaatagtggatgggactgacacaatctacgccggactccgtgaacgggccgattcaccccctccagagacaacgccaagaacacactatatctgcaaatgaacagtctgagagccgaggacacggctgtctattactgtgcaagaggtggctacaatcatggttttgattctctaggggccaagggacaatggtcaccgtctcttcagcctccaccaagggccccatccggtcttccccctggccaccctgctccaggacncacctccganagcacncgcgccctgggctgcctgtcgaacggactacttcctattgtactactctggagcgggctggcaaggcgcatagnnnnnngnnnnnnnnnnnnnnnnnnnnnnnnnnnnnnn

SEQ ID NO: 213659 - DNA, 425 bp, Homo sapiens
  misc_feature: GYAE6OF02FZFF7.29.27.C05.1.454.CMB.1.raw
  modified_base (327)..(327): a, c, t, g, unknown or other
  misc_feature (327)..(327): n is a, c, g, or t
  modified_base (416)..(425): a, c, t, g, unknown or other
  misc_feature (416)..(425): n is a, c, g, or t
tcagatagagtactcacgaccggtgctcgatttagacgcgatcgaagggcgtggtgtgggtctcacgttattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaaggggacaatggtcaccgtctcttcagcctccaccaagggccccatcggtcttccccctggcgcccctgcctccaggngcacctccgagagcacagcggccctggggctgcctggtcaaggactacttcctatgtatactctgagcgggctgggcaaggcgcatagnnnnnnnnnn

SEQ ID NO: 213660 - DNA, 558 bp, Homo sapiens
  misc_feature: GYAE6OF02H1QWQ.29.27.C05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgctccaggggaaangccaccttcncctgcagggccagtcagagtgttggcacctacatagcctggtaccaacagaaacctggccaggctccaggctcctcatctatgatgcataccaaaagggcctctggacactcccagcctaggttcagtggcaggtgggtctgggacaggtacttcgactctcaacctatcagtacgcctagacgtcctagaagtattttgacttagtttattactgttcagctagtcgtagcgtacgtggtcgtcgggtctcgtacgtttcgggacgggtaggaccgtaagggtaggagtaacgtacgaaacggtacgtggtacggtcgtggaccaccgattcgtgttcttctaccg

SEQ ID NO: 213661 - DNA, 418 bp, Homo sapiens
  misc_feature: GYAE6OF02H7HO6.29.27.C05.1.454.CMB.1.raw
  modified_base (387)..(387): a, c, t, g, unknown or other
  misc_feature (387)..(387): n is a, c, g, or t
  modified_base (412)..(418): a, c, t, g, unknown or other
  misc_feature (412)..(418): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaagggacaatggtcaccgtctcttcagcctccaccaagggcccatcggtccttcccctggccgccctgctccaggacgcacctccgagacgcacagcggcccgtgggctgcctggtcaaggctacttcctatgtatactntgagcgggctggcaaggcgcatagnnnnnnn

SEQ ID NO: 213662 - DNA, 425 bp, Homo sapiens
  misc_feature: GYAE6OF02F9HL7.29.27.C05.1.454.CMB.1.raw
  modified_base (402)..(425): a, c, t, g, unknown or other
  misc_feature (402)..(425): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctgggggccaagggacaatggtcaccgtctcttcagcctccacagggcccatcggtcttcccctggcgccctgctccaggcgcacctccgagagcacagcggcctgggctgcctggcaaggctactcctatgtatactctgagcggctggcaaggcgcagtagnnnnnnnnnnnnnnnnnnnnnnnn

SEQ ID NO: 213663 - DNA, 411 bp, Homo sapiens
  misc_feature: GYAE6OF02JDECP.29.27.C05.1.454.CMB.1.raw
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (401)..(401): a, c, t, g, unknown or other
  misc_feature (401)..(401): n is a, c, g, or t
  modified_base (409)..(411): a, c, t, g, unknown or other
  misc_feature (409)..(411): n is a, c, g, or t
tcagatagagtactcacgaccggtgctcgatttagacgcgatcgaagggctggtgtgggtctcacgtattaatagtgatgggactgacacaatctacgcggactccgtgaaggccgattcaccccctccagagacaacgccaagaacacactatatctgcaaaatgaacagtctgagagccgaggacacggctgtctattactgtgcaagaggtggctcaaatcatggttttgatctctggggccaagggacaatggtcaccgtctcttcagcctccaccaaagggcccaatcggtcttccccctggcgccctgctccaggncacctccganagcacagcggccctgggctgcctggtcaaggactattcctaatgtatactctgagcgggctggcaaggngcaatagnnn

SEQ ID NO: 213664 - DNA, 420 bp, Homo sapiens
  misc_feature: GYAE6OF02FTWDT.29.27.C05.1.454.CMB.1.raw
  modified_base (410)..(420): a, c, t, g, unknown or other
  misc_feature (410)..(420): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggcaccgtctcttcagcctccaccaagggccccatccggtcttccccctggcgcccctgcctccaggagcacctccgagagcacagcgccctgggctgcctggtcaaggactacttcctatgtatactctgagcgggctggcaaggcgcatagnnnnnnnnnnn

SEQ ID NO: 213665 - DNA, 517 bp, Homo sapiens
  misc_feature: GYAE6OF02FZP6Y.29.27.C05.1.454.CMB.1.raw
  modified_base (202)..(202): a, c, t, g, unknown or other
  misc_feature (202)..(202): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtacgcctagagcctgaagtattttgctagtttattactgttcagcagcgtagcgacgtggcgtggctcgacgtttcggcggagggaccgaagggtagagatacgaaacgaacgtgtggctgaccaccatctgttctctaccg

SEQ ID NO: 213666 - DNA, 513 bp, Homo sapiens
  misc_feature: GYAE6OF02HACQ0.29.27.C05.1.454.CMB.1.raw
  modified_base (489)..(513): a, c, t, g, unknown or other
  misc_feature (489)..(513): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggccccatcggtccttcccccctggccgcccctgcctcccagggacgccaccctccggagacggccaacgacgccggccccgtgggggccttcggcccttgggtaccaaacgggtaccttaacccgtttccccttccgttccgttccgaaccttccgtggacggtccgggggcttggggacccgaaacgggccgaccaagtaggnnnnnnnnnnnnnnnnnnnnnnnnn

SEQ ID NO: 213667 - DNA, 410 bp, Homo sapiens
  misc_feature: GYAE6OF02FFJM4.29.27.C05.1.454.CMB.1.raw
  modified_base (408)..(410): a, c, t, g, unknown or other
  misc_feature (408)..(410): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctgggggccaagggacaatggtcaccgtctcttcagcctcaccaagggcccatcggtcttccccctggcgccctgctccaggagcacctccgagagcacagcggccctgggctgcctggtcaaggactacttcctctctcgactctgagcgggctggcaaggcgcatagnnn

SEQ ID NO: 213668 - DNA, 419 bp, Homo sapiens
  misc_feature: GYAE6OF02GAXEH.29.27.C05.1.454.CMB.1.raw
  modified_base (408)..(419): a, c, t, g, unknown or other
  misc_feature (408)..(419): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaaagggacaatggtaccaccgtctcttcagcctccaccaaggccatcggtctcccctgcgccctgctccagagcactccgagagcacagccggccctggggcctgcctggtcaaggctacttcctatgttactactctgagcgggctggcaaggcgcatagnnnnnnnnnnnn

SEQ ID NO: 213669 - DNA, 427 bp, Homo sapiens
  misc_feature: GYAE6OF02HFQSB.29.27.C05.1.454.CMB.1.raw
  modified_base (323)..(323): a, c, t, g, unknown or other
  misc_feature (323)..(323): n is a, c, g, or t
  modified_base (416)..(427): a, c, t, g, unknown or other
  misc_feature (416)..(427): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaagggacaatggtcaccgtctcttcagcctccaccaagggcccatcggtccttccccctggcgccctgctccaggnccacctccgagagcacagccggccctgggctgcctggtcaaggactacttcctatgtactactctgacgcgggctggcaacggcgacgatagnnnnnnnnnnnn

SEQ ID NO: 213670 - DNA, 713 bp, Homo sapiens
  misc_feature: GYAE6OF02JZ832.29.27.C05.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
tcagatagagtactcacgaccggtgctcgatttagacgcgatcgaagggtttgggggtaggaacgtgctcagttaggacccagagggaaccatggaagccccagctcagcttctcttcctcctgctactctggctcccagactgccaccggagaagtgtgttgacgacagtctccagccaccctgtctttgctccaggggaangccacttcncctgcagggccagtcagagtgttggcacctanatacgccttggtaccaacagaaacctggccagctcccaggctcctcgatctatgactgctactacgaaaacgggtcctacgtcggctacgtaccccacgctacggttcacgtacggctaaggtcgggtctcgggacaacggtcttacgacgtacctaccgaccgtaatccggaagttaccggccttaacggaccgtaccgttaggtaaacgttcgttttaggtacgttaagttttaacgtttaccctaggtttaccgtagaccgtaaggttccggtaaacgccggttacggttaccgggtacgggttaccggggtaccttaccggttaccggttttaccggggaacggggtaccggtaaaccggaaggggttaccgagggtacccgttaacggaaaccggtttaacgtcgggtacgggttaccgtacggtaccacgtaccgtttacgtcgttacccgttacgtaacccg

SEQ ID NO: 213671 - DNA, 447 bp, Homo sapiens
  misc_feature: GYAE6OF02G35F5.29.27.C05.1.454.CMB.1.raw
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (421)..(447): a, c, t, g, unknown or other
  misc_feature (421)..(447): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaagggacaatggtcaccgtctcttcagcctccaccaaggcccatcgtctccccctggccnccctgctcaggngcacctcgagagcacagccggccctgggcctggcctggcaacggacttacgttcctatgtaatactctggagcgggcttgggacaacgggcgactatacggnnnnnnnnnnnnnnnnnnnnnnnnnnn

SEQ ID NO: 213672 - DNA, 413 bp, Homo sapiens
  misc_feature: GYAE6OF02GLZOY.29.27.C05.1.454.CMB.1.raw
  modified_base (234)..(234): a, c, t, g, unknown or other
  misc_feature (234)..(234): n is a, c, g, or t
  modified_base (393)..(393): a, c, t, g, unknown or other
  misc_feature (393)..(393): n is a, c, g, or t
  modified_base (408)..(413): a, c, t, g, unknown or other
  misc_feature (408)..(413): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttnatctctggggccaagggacaatggtcaccgtctcttcagcctccaccaagggcccatcggtcttccccctggccgccctgctccaggacgcacctccgagagcacagcggccctgggctgcctggtcaggactacttcctatgtatactctgagcgggntggcaaggcgcatgnnnnnn

SEQ ID NO: 213673 - DNA, 426 bp, Homo sapiens
  misc_feature: GYAE6OF02I6FV4.29.27.C05.1.454.CMB.1.raw
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (390)..(391): a, c, t, g, unknown or other
  misc_feature (390)..(391): n is a, c, g, or t
  modified_base (403)..(426): a, c, t, g, unknown or other
  misc_feature (403)..(426): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacaggctgtctattactgtgcaagaggtggctacaatcagttggttttgatctcgtggggccaagggcaatggtcaccgtctcttcagcctccaccgaaggtcccatcggtcttcccccgtggccgccctgctccaggancacctcgnancacagcgcctgggcncgctggtcaggactactctctctcgactctgacgtcggnngcgagcgcatgnnnnnnnnnnnnnnnnnnnnnnnn

SEQ ID NO: 213674 - DNA, 424 bp, Homo sapiens
  misc_feature: GYAE6OF02IN6R8.29.27.C05.1.454.CMB.1.raw
  modified_base (319)..(319): a, c, t, g, unknown or other
  misc_feature (319)..(319): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (412)..(424): a, c, t, g, unknown or other
  misc_feature (412)..(424): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgagacacggctgtctattactgtgcaagagtggctacaatcatggttttgatctctggggccaagggacaatggtcaccgtctcttcagcctccacaaggcccatcggtcttccccctggcgccctgctccaggacncaccgtccgagacgccacagtccggccctggggctcgccttggcaacggtactacttcctctctcgactctgacgcggctggcaggcncangnnnnnnnnnnnnn

SEQ ID NO: 213675 - DNA, 441 bp, Homo sapiens
  misc_feature: GYAE6OF02FHBNT.29.27.C05.1.454.CMB.1.raw
  modified_base (422)..(441): a, c, t, g, unknown or other
  misc_feature (422)..(441): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaagggacaatggtcaccgtctcttcagcctccaccaagggccccatccggtcttccccctggccgccctgcctccaggacgcaccctccgagagcacagccggccctgggctgcctggtcaaggactacttcctatgtatactctgacggcgggtctgggcaaggcgacagtagnnnnnnnnnnnnnnnnnnnn

SEQ ID NO: 213676 - DNA, 420 bp, Homo sapiens
  misc_feature: GYAE6OF02F5PBE.29.27.C05.1.454.CMB.1.raw
  modified_base (327)..(327): a, c, t, g, unknown or other
  misc_feature (327)..(327): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (415)..(420): a, c, t, g, unknown or other
  misc_feature (415)..(420): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaaggggacaatggtcaccgtctcttcagcctccaccaagggccccatcggtcttcccccgtggccgccctgcctccgaggngcacctccgagagcacagccggccctgggctcgcctggtcaaggactacgttcctatgtactctctgagcggntggcaggcncatagnnnnnn

SEQ ID NO: 213677 - DNA, 666 bp, Homo sapiens
  misc_feature: GYAE6OF02I7M8V.29.27.C05.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (460)..(460): a, c, t, g, unknown or other
  misc_feature (460)..(460): n is a, c, g, or t
tcagatagagtactcacgaccggtgctcgatttagacgcgatcgaagggtttagggggaggaactgctcagttaggacccagagggaaccaatggaagccccagctcagcttctcttcctcctgctactctggctcccagatgccaccggagaaagtgtgttgacacagtctccagccacctgtctttgtctccaggggaaangccaccttctcctgcaggccagtcagngtgtggcacctanatagcctggtacccaanagaaacctggccaggctcccaggcctctcatctatgatgtaccataccgaaaaggggtccctacgtgggaccacttccccaacgtccctaggttccaggtcggcgtagggtcgggtacgtcggggactaggtacctttacaccttccgtccaccatacgacgtacgtaccgtagacgtcctaggaacgttagttttacgngttaggtttacttacgttcgttacgtgtacctggacgttagaccgtacggtcggtccggtcggtaccgttcgttaccggtttaccgggtacgggacgggtaacgtaagggtacggtacgtacggtaaccgtaaaaccggtacgttagggtaccggttacgtcggacctaccggtagtttcccgttacggttcccttacgttacccg

SEQ ID NO: 213678 - DNA, 430 bp, Homo sapiens
  misc_feature: GYAE6OF02HZ3PE.29.27.C05.1.454.CMB.1.raw
  modified_base (418)..(430): a, c, t, g, unknown or other
  misc_feature (418)..(430): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaagggacaatggtcaccgtctcttcagcctccaccaagggcccatcggtccttccccctggccgccctgcctccgaggacgcaccctccgagacgcacagccggccctgggctgcctggcaaggactacttcctatgtatactctgaggcgggctggcgaggcgacatagnnnnnnnnnnnnn

SEQ ID NO: 213679 - DNA, 711 bp, Homo sapiens
  misc_feature: GYAE6OF02JCMOP.29.27.C05.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccaccctgtctttgtctccaggggaaangccaccttctcctgcagggccagtcagagtgttggcacctacatagcctggtaccaanagaaacctggccaggctccaggctcctcatctatgatgcataccgaaaagggcctctcggcactcccagccaggtttcacgtggcaggtggttcgtcgggactagtaacgttcaccgttctaccgaacctacgtacaacggttacgacccgttaaggacgacccgttaagggtaaacgttagtttttacggaccgttaaggtttttaacgtttaccgttagttaccgtaagtccgttaaacggtccggtacggtacccggttaacggttcggggtaccgggttaccggggtaccgttaaccggttaccgttttaccgggggaccgggtaaacggggtaacccgttaaggggtacgtaacggtacggtaaccgaaaaccgggtaacgttacggggttaggtacccgttaggacccgtacctagttacccttagggttaccttaccgttaccg

SEQ ID NO: 213680 - DNA, 587 bp, Homo sapiens
  misc_feature: GYAE6OF02JIAYC.29.27.C05.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (328)..(328): a, c, t, g, unknown or other
  misc_feature (328)..(328): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (571)..(571): a, c, t, g, unknown or other
  misc_feature (571)..(571): n is a, c, g, or t
  modified_base (578)..(578): a, c, t, g, unknown or other
  misc_feature (578)..(578): n is a, c, g, or t
tcagatagagtactcacgaccggtgctcgatttagacgcgatcgaagggctggtgtgggtctcacgtattaatagtgatgggactgacacaatctacgcggactccgtgaagggccgattcaccccctcagagacaacgccaagaacacactatatctgcaaatgaacagtctgagagccgaggacacggctgtctattactgngcaagaggtgctanaatcattggtttnatctcgtggggccaagggacaagtggtcaccgtctcttnacgcctccaaccaacgggcccatccggtcttcccccgtgccgcctcgcctccgaggcncaccctcggacgacgccacgacggtcggaccccgtggggaccttcggcccgtttcgggacctaaacgggtaccttaccgtttaccctagttacgttaactaacgttcccgttaagggacgtccggggtaccgttagggaccgaaacgggcgtaaccgtagttaacggcngtacgacgcgncgcgctcncgtacgacgtgtntagtcgtcgcnctcgngcgngtcgctcacgtcacgtacgtcncgtcgtntctcgcgcg

SEQ ID NO: 213681 - DNA, 524 bp, Homo sapiens
  misc_feature: GYAE6OF02ICPDT.29.27.C05.1.454.CMB.1.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (457)..(457): a, c, t, g, unknown or other
  misc_feature (457)..(457): n is a, c, g, or t
  modified_base (469)..(469): a, c, t, g, unknown or other
  misc_feature (469)..(469): n is a, c, g, or t
  modified_base (490)..(524): a, c, t, g, unknown or other
  misc_feature (490)..(524): n is a, c, g, or t
tcagatagagtactcacgaccggtgctcgatttagacgcgatcgaaggggcgtggtgtgggtctcacgtattaatagtgagtgggactgacacaatctacgcggactccggtgaacgggccattccaccccctcagacgacaacgccaagacacactatatctgacaaatcgaactagtctgagacgccgagacacggctgtctatacngagcaagnggtgctanatnattgtttgatctgtaggggacaagggtactagtgggtccacggttctcgttaccagtacccctaccgaacccgaaggggtcccacgttccggttccccttcccccgtggcccgtcccctagtccctccgaaacggcgacccgtacccgtaccggagacggtacaacgacggtcccggcccgtaggccttacggcctagggacaaggtcctaattccaatccgaatcctnagcggtccgggnttcggacgtaagccgatagtnnnnnnnnnnnnnnnnnnnnnnnnnnnnnnnnnnn

SEQ ID NO: 213682 - DNA, 482 bp, Homo sapiens
  misc_feature: GYAE6OF02IWSEH.29.27.C05.1.454.CMB.1.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (448)..(482): a, c, t, g, unknown or other
  misc_feature (448)..(482): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcacccccctccagagacaacgccaagaacacactatatctgcaaatgaacagtctgagagccgaggacacggctgtctattacngtgacaagaggtggctacaatcattggttttnatctctggggccaagggacaatggtcaccgtctcttcagcctaccaccaacggcccatcggtcctccccgtggcgccctgctccgaggagcaccctcgagacgccacacgccggccctggggcctggcccgtggtactaaagggacttaaccgttcctagtagttactactcgtcggagccgggctagggcaaagggcgacaagtagcgannnnnnnnnnnnnnnnnnnnnnnnnnnnnnnnnnn

SEQ ID NO: 213683 - DNA, 524 bp, Homo sapiens
  misc_feature: GYAE6OF02IIZNF.29.27.C05.1.454.CMB.1.raw
  modified_base (370)..(370): a, c, t, g, unknown or other
  misc_feature (370)..(370): n is a, c, g, or t
  modified_base (496)..(498): a, c, t, g, unknown or other
  misc_feature (496)..(498): n is a, c, g, or t
  modified_base (500)..(524): a, c, t, g, unknown or other
  misc_feature (500)..(524): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccaccccctccagagacaacgccaaagaacacactatatctgcaaatgaacagtctgagagccgaggacacggctgtctattactgtgcaaggaggtggctaacaatcagttggttttgattcgtcgtgggggaccaagggactaagtggtcacccgttcttccttcacgcccctccaaccgaacggggccccctagttccgggtccctttcccccccgtgggcccgtcccctcggcctccgagggacncccacccgtcgagacgacacgacgccggcccgtggggcctcgccgtggtacgaacggtaccttaaccttcccttaattcgtacttacctcgtggacggccgggtcgtggacgaaggcaccagtagnnngnnnnnnnnnnnnnnnnnnnnnnnnn

SEQ ID NO: 213684 - DNA, 601 bp, Homo sapiens
  misc_feature: GYAE6OF02HYQJ8.29.27.C05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (503)..(503): a, c, t, g, unknown or other
  misc_feature (503)..(503): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (557)..(557): a, c, t, g, unknown or other
  misc_feature (557)..(557): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctcagagacaacgccaagaacacactatatctgcaaatgaacagtctgagagccgaggacacggctgtctattacngtgcaagaggtgactacaatcatcggtttgatctcgngggaccaaggacaatggtcaccgtctcttcagcctccaccaagggcccaagtcggtccttaccccctggaccgtcccctgctccagggtacgccaccgtccgagagccacgacgccggtaccccgtggggacctcggccgttacggtacgaaacgggtaccttaaacgtttccgtaattccggtaattaaccccgttgtacggaacgggtcccggggtacgtcgggaaccgtaaacggggtaccgtaccgaaagtacgacgtntacgtagcacncgagcanccgtgacgtagctagcacgngtacngagactagtanacgatacgtacacgcgtacgtcacgtacgtacgtacgtacgacg

SEQ ID NO: 213685 - DNA, 454 bp, Homo sapiens
  misc_feature: GYAE6OF02I8GMW.29.27.C05.1.454.CMB.1.raw
  modified_base (222)..(222): a, c, t, g, unknown or other
  misc_feature (222)..(222): n is a, c, g, or t
  modified_base (435)..(435): a, c, t, g, unknown or other
  misc_feature (435)..(435): n is a, c, g, or t
  modified_base (437)..(454): a, c, t, g, unknown or other
  misc_feature (437)..(454): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaaacagtctgagagccgaggacacggctgtctattactgtgcaagaggtggctanaatcattggttttgattctcgtggggccaagggacaatggtcacgtctcttcagcctcccaccaacggcccatcgtccttccccctggcgccctgctccgaggcgcaccctccgagagccacacgccggcccgtgggctcgccgtggtcgaacggacttaccttcctctcctcgtacctccgtgacggcgggtcgtggacgaggcgctatagncnnnnnnnnnnnnnnnnnn

SEQ ID NO: 213686 - DNA, 417 bp, Homo sapiens
  misc_feature: GYAE6OF02FTWDR.29.27.C05.1.454.CMB.1.raw
  modified_base (405)..(405): a, c, t, g, unknown or other
  misc_feature (405)..(405): n is a, c, g, or t
  modified_base (411)..(417): a, c, t, g, unknown or other
  misc_feature (411)..(417): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaaggggacaaatggtcaccgtctcttcagcctccaccaagggccccatcggtcttccccctggcgccctgctccaggagcacctccgagagcacagcggccctggggctgcctggtcaaggactactcctatgtatactctgagcgggctggcaaggcncatagnnnnnnn

SEQ ID NO: 213687 - DNA, 535 bp, Homo sapiens
  misc_feature: GYAE6OF02J02QJ.29.27.C05.1.454.CMB.1.raw
  modified_base (349)..(349): a, c, t, g, unknown or other
  misc_feature (349)..(349): n is a, c, g, or t
  modified_base (496)..(496): a, c, t, g, unknown or other
  misc_feature (496)..(496): n is a, c, g, or t
  modified_base (500)..(507): a, c, t, g, unknown or other
  misc_feature (500)..(507): n is a, c, g, or t
  modified_base (509)..(535): a, c, t, g, unknown or other
  misc_feature (509)..(535): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgacaaggaggtggactacaatcattggttttagatcgtcgtgggggaccaaggggtacaagtggtcaccgttctcttcacgcctaccaccgaagggcccctatccgggtccttcccccgtggccgtccctggctccgaggacnccaacctccgagacgcaccgacggccggtcccgtagggcctcgaccggttggacgtaaggaccctttacctcccgttagtcggttataccttacggtcgaggtccggggtccgttacgggactaacgggccgacgtagttaacgctncgannnnnnnncnnnnnnnnnnnnnnnnnnnnnnnnnnn

SEQ ID NO: 213688 - DNA, 418 bp, Homo sapiens
  misc_feature: GYAE6OF02HG8S8.29.27.C05.1.454.CMB.1.raw
  modified_base (411)..(418): a, c, t, g, unknown or other
  misc_feature (411)..(418): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggccccatcggtcttccccctggcgcccctgctccaggacgcacctccgagagcacagcggccctgggctgcctggtcaaggactacttcctctctcgactctgagcgggctggcaaggcgcatagnnnnnnnn

SEQ ID NO: 213689 - DNA, 584 bp, Homo sapiens
  misc_feature: GYAE6OF02GLPGL.29.27.C05.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
  modified_base (531)..(531): a, c, t, g, unknown or other
  misc_feature (531)..(531): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (543)..(545): a, c, t, g, unknown or other
  misc_feature (543)..(545): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (560)..(562): a, c, t, g, unknown or other
  misc_feature (560)..(562): n is a, c, g, or t
  modified_base (564)..(566): a, c, t, g, unknown or other
  misc_feature (564)..(566): n is a, c, g, or t
  modified_base (568)..(569): a, c, t, g, unknown or other
  misc_feature (568)..(569): n is a, c, g, or t
  modified_base (571)..(574): a, c, t, g, unknown or other
  misc_feature (571)..(574): n is a, c, g, or t
  modified_base (576)..(584): a, c, t, g, unknown or other
  misc_feature (576)..(584): n is a, c, g, or t
tcagatagagtactcacgaccggtgctcgatttagacgcgatcgaagggctggtgtgggtctcacgtattaatagtgatgggactgacacaatctacgcggactccgtgaagggccattcaccccctcagagacaacgccaaagaacacactatatctgcaaatgaacagtctgagagccgagacacggctgtctattacngtgcaagnggtgctagaatcagttgggtttanactccgtcgtcgggggaccaaagggactaagtcgggtcctaccgttcgtctttaccacgtccccttcccaacgaacgggtcccctaagtccggttacccttccccccgtggacccgtccccgtgcccttacccgagggatccccccccctagttccggacgaacgccacgacgccggtacccctggggccttcggccggttaggtaccaaagggtacctttaccgttccctacgttccgtactacttcgtgggaccggtcgggtccgtacggaccgtaacgggtcctaacgagtacgntcgnacngntcnnnctnatcgnagtnacnnncnnngnngnnnnannnnnnnnn

SEQ ID NO: 213690 - DNA, 626 bp, Homo sapiens
  misc_feature: GYAE6OF02GZK85.29.27.C05.1.454.CMB.1.raw
  modified_base (203)..(203): a, c, t, g, unknown or other
  misc_feature (203)..(203): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaagtgtgttgacacagtctccagccacctgttctttgtctccgaaggggaaancgcctaccttctcctgcgagggccagtcagtagtgttggccacctacagtacgcctcggtaaccaacgaagaaacctcggccaaggcctacccaaggcctccctcacttctatgatcgactactaccgaaaaggcctctggcactcccgagccgtacggttcgagtgcgtaggtggtcgtgggacagacatcactctcactactacagtacgcctagacgtctaggtaacttgttttacgcttaagttttattaacgttgtacagtacaggtaccgttaggcgtaacggtcggtaccggtcgggtccttcgttacgtttcgggaccgggaacggggaacctaagggtaggaacgtacgtaaccggaaaacgtacggtaggtacgtagtccgtacgtaccgtactcgttagttaccgtttaccg

SEQ ID NO: 213691 - DNA, 474 bp, Homo sapiens
  misc_feature: GYAE6OF02GXUOL.29.27.C05.1.454.CMB.1.raw
  modified_base (233)..(233): a, c, t, g, unknown or other
  misc_feature (233)..(233): n is a, c, g, or t
  modified_base (307)..(307): a, c, t, g, unknown or other
  misc_feature (307)..(307): n is a, c, g, or t
  modified_base (422)..(422): a, c, t, g, unknown or other
  misc_feature (422)..(422): n is a, c, g, or t
  modified_base (458)..(474): a, c, t, g, unknown or other
  misc_feature (458)..(474): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggtttnatctcgtgggccaagggacaatggtcaccgtctcttcagcctccaccgaagggcccatccggtccttcccccgngggtccgcccctgcctacccgaggacgtccacctcccgagacgcacacgccggccctggggctcgccgtggtaccaaggtaccttaccgttccctaattcgttaacttaccttcnggacggcgggtcgtgggacaacgggccgacagtagnnnnnnnnnnnnnnnnn

SEQ ID NO: 213692 - DNA, 427 bp, Homo sapiens
  misc_feature: GYAE6OF02GBKE3.29.27.C05.1.454.CMB.1.raw
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (387)..(387): a, c, t, g, unknown or other
  misc_feature (387)..(387): n is a, c, g, or t
  modified_base (409)..(427): a, c, t, g, unknown or other
  misc_feature (409)..(427): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaaggggacaatggtcaccgtctcctcagcctccacaagggccccatcggtctcccctggcncccngctcaggagcacctccgagagcacagccggccctggggctgcctggtacaaggacttacttcctatgtatactcgngagcggctggcaggcgcatagnnnnnnnnnnnnnnnnnnn

SEQ ID NO: 213693 - DNA, 957 bp, Homo sapiens
  misc_feature: GYAE6OF02GKBGC.29.27.C05.1.454.CMB.1.raw
tcagatagagtactcacgaccggtgctcgatttagacgcgatcgaagggtttgggggaggaactgctcagttaggacccagagggaaccatggaagccccagctcagcttctcttcctcctgctactctggctccagatgccaccggagaaagtgtgtgacacagtctaccagccacctgtctttgtctccgagggtaagcgcctacttctcctgcgacgggccaggtactaggtaggtgttcggacctaccgtactacgtacggaccgttacgggtaaccaaacgtacggtaaaaccgtcgggaccgtaacggaccttcccccgaggtcccctacccgttcgaacgttccgttaacttcggtaacttccggtaccgtaaccgttaaccccggtaaaaaacgggggtcccttaccggttacgggacctaaccgttacccccgaacgggtaccccgtaggggttttacccaagggtttccggacgtacggggttcgggggttaccgtagggggaactaacgggttaaccgtttccgtaacccgtttccgtacctaacccgttaagtacccgggtaaacgttaacgtacccgttaaacgggaacggttaccccgttaagggtaaaacggtttacggttttaacggaacccgtttttacggttttaaaccggtttaaccgtttcgggttaacgtaacggttaccgtaacgggttccggttaaccgggtaccggttacccgggttacggggggtccggttacggggtcccgttttaccgggttaacccgggttttaccggggggaaaccgggttaaccgggggtaaacggttaacggggttaaccgggaacggtaacggttaaacccgggtaaaacgggtacgggttacggggttaacggccggtttacggaaccgtcccttaagttcccggttaacggtttacccttaggttaacccccg

SEQ ID NO: 213694 - DNA, 487 bp, Homo sapiens
  misc_feature: GYAE6OF02GQPJV.29.27.C05.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (298)..(299): a, c, t, g, unknown or other
  misc_feature (298)..(299): n is a, c, g, or t
  modified_base (315)..(315): a, c, t, g, unknown or other
  misc_feature (315)..(315): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (452)..(456): a, c, t, g, unknown or other
  misc_feature (452)..(456): n is a, c, g, or t
  modified_base (458)..(460): a, c, t, g, unknown or other
  misc_feature (458)..(460): n is a, c, g, or t
  modified_base (462)..(462): a, c, t, g, unknown or other
  misc_feature (462)..(462): n is a, c, g, or t
  modified_base (464)..(466): a, c, t, g, unknown or other
  misc_feature (464)..(466): n is a, c, g, or t
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
  modified_base (473)..(475): a, c, t, g, unknown or other
  misc_feature (473)..(475): n is a, c, g, or t
  modified_base (477)..(479): a, c, t, g, unknown or other
  misc_feature (477)..(479): n is a, c, g, or t
  modified_base (481)..(484): a, c, t, g, unknown or other
  misc_feature (481)..(484): n is a, c, g, or t
  modified_base (486)..(487): a, c, t, g, unknown or other
  misc_feature (486)..(487): n is a, c, g, or t
tcagatagagtactcacgaccggtgctcgatttagacgcgatcgaaggggctggtgtgggtctcacgtattaatagtgatgggactgacacaatctacgcggactccgtgaagggccgattccaccccctccagagacaacgccaaagaacacactatatctgcaaatgaacagtctgagagccgaggacacggctgtctattactgtncagaggtgctanaatcatggtttgatctctgggacaagggacaatggtcacgtctcttcagcctcacaggccatcgtctcccngcnccnnctcagcgcacctcganagcacacgccggcctgggctcgaccgtcggtacaacggaccttaccttcctacttaggtacttaacctcgttacggacggtccgggtcgtagggaccgtaaacggccgtacgaatacggnagtacangngnantgannnnncnnncnannncncgnannnannncnnnncnn

SEQ ID NO: 213695 - DNA, 555 bp, Homo sapiens
  misc_feature: GYAE6OF02IZOFA.29.27.C05.1.454.CMB.1.raw
  modified_base (105)..(105): a, c, t, g, unknown or other
  misc_feature (105)..(105): n is a, c, g, or t
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (524)..(524): a, c, t, g, unknown or other
  misc_feature (524)..(524): n is a, c, g, or t
  modified_base (535)..(535): a, c, t, g, unknown or other
  misc_feature (535)..(535): n is a, c, g, or t
tcagatagagtactcacgaccggtgctcgatttagacgcgatcgaagggtttgggggaggaactgctcagttaggacccagagggaaccatggaagccccagctnagcttctcttcctcctgctactctggctcccagatgccaccggagaaagtgtgttgacacagtctccagccacctgtctttgtctcaggggaangccacttctcctgcagggcagtcagagtgttggcacctanatagcctggtaaccaanacgaaacctggaccaggcctcccaggctcctcatctatgatgcatacgaaaacgggcctctcggctacgtcccagccgtaggttcagtggctaggtgggtctgggacgagacgttcaactcacacatcaagtctaccgtaagacgcccaggtaagtatttggtactagttttattacttgtctagtcgagacgtagacgtactggtcgtcggctcgtattccgggacgggtacggacgtaaggagagacttacgaaacggaacttggngtacgtgtacncgtatcgtgttacttctacg

SEQ ID NO: 213696 - DNA, 795 bp, Homo sapiens
  misc_feature: GYAE6OF02JVJRP.29.27.C05.1.454.CMB.1.raw
  modified_base (205)..(205): a, c, t, g, unknown or other
  misc_feature (205)..(205): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatgccaccggagaaagtgtgttgacacagtctccagccacctgtctttgtcctaccgaaggggaaangcctaccttctcctgccgacgggccagtcgagtacgtggttggtccaccgtacatacggccgtacggtaaccaaacgacggaaaaccgtcggacccaagggtcccacccgtaacggtcccttccctacgtacttacctaagttcgacgttacgaccttaacgtaaacccggaaaacggggtcccttacggttcgggacctacgttaccccggagtacccggtaacggttcgacgggttacggaccgtagggttcggggtttacgacgggtaaccgtaacgtacgttaccgacgtttacccacgtaacccgtataacggtacggttaacgccggtttaacgacgttaaccgttacggtaagttttaacgttccggttaacgtttaacgtttaacggtttaccttaccggttacgtacgtacgtaaccggtacggttcgaccgggtacgttacgggtccgttagggtccgttacggttaccgggttcgggaccgggtaaacggtaccggtaaggacggttacgaacgtaacgaaaggttacgtcggttacgaccgttgaacgtctaccgtgttacgtacccttagttccccg

SEQ ID NO: 213697 - DNA, 510 bp, Homo sapiens
  misc_feature: GYAE6OF02F2Q79.29.27.C05.1.454.CMB.1.raw
  modified_base (242)..(242): a, c, t, g, unknown or other
  misc_feature (242)..(242): n is a, c, g, or t
  modified_base (473)..(473): a, c, t, g, unknown or other
  misc_feature (473)..(473): n is a, c, g, or t
  modified_base (475)..(477): a, c, t, g, unknown or other
  misc_feature (475)..(477): n is a, c, g, or t
  modified_base (479)..(510): a, c, t, g, unknown or other
  misc_feature (479)..(510): n is a, c, g, or t
tcagatagagtactcacgaccggtgctcgatttagacgcgatcgaaggggctggtgtgggtctcacgtattaatagtgatgggactgacacaatctacgaggactccgtgaagggccgattcaccccctcagagacaacgccaagaacacactatatctgcaaatgaaacagtctgagagccgaggacacggctgtctattactgtgcaagaggtggctacaatcattggttttgatctcgngggggaccaaagggacaatggtcaaccgtctcttcagcctcaccaagggccccatcggtctccccctggcgcctgctccaggagcacctccgagagccacgagcggtcccctggggctaggcccgtggtaccaaagggacccttaacgtttccctaattacgttactaaccttcgtacggaagggccggggtactcggggtaccaaaagggcggtaccctaagttaagggnannncnnnnnnnnnnnnnnnnnnnnnnnnnnnnnnnn

SEQ ID NO: 213698 - DNA, 661 bp, Homo sapiens
  misc_feature: GYAE6OF02HWG3A.29.27.C05.1.454.CMB.1.raw
  modified_base (198)..(198): a, c, t, g, unknown or other
  misc_feature (198)..(198): n is a, c, g, or t
  modified_base (597)..(597): a, c, t, g, unknown or other
  misc_feature (597)..(597): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (638)..(638): a, c, t, g, unknown or other
  misc_feature (638)..(638): n is a, c, g, or t
  modified_base (653)..(653): a, c, t, g, unknown or other
  misc_feature (653)..(653): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
tcagatagagtactcacgaccggtgctcgatttagacgcgatcgaaggggctggtgtgggtctcacgtattaatagtgatgggactgacacaatctacggcggacctccgtgaaggcgattccaccccctccagagacaacgccaaagaccacacctatatctagcaaatgaacagtcgtgagagccgaggacacggntgtctattactgtgacaaggtggtcggctactaatcgtagttggttttacgatcttcggcggggaccgaaagggaactaagtcgtaccgtccgtcttccgtacacggccccttacgaaccgtaccgggtccctacggtcccggttacccttccccccgtcggaacccgtcccgtcggtccttacccggacggtacccgtcccgtacccgtccgaacgacgaccgtacggaccggcccggtcccgtcggggcgttacgtcccgtacgggtacttaaccgggaccttttaccgtaccgttaacttacggttaactttacccttcggtacgggtaaccggtcgggtaaccgtcgaacgggtacggaccgtacgtaaagcgtgacttaggcaggcagcggtangtcgacacngnacgtacgcacacgagcgtgnagngntcgtnactacgtagtcactntgtntncg

SEQ ID NO: 213699 - DNA, 607 bp, Homo sapiens
  misc_feature: GYAE6OF02FZMIB.29.27.C05.1.454.CMB.1.raw
  modified_base (211)..(211): a, c, t, g, unknown or other
  misc_feature (211)..(211): n is a, c, g, or t
  modified_base (284)..(284): a, c, t, g, unknown or other
  misc_feature (284)..(284): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (553)..(553): a, c, t, g, unknown or other
  misc_feature (553)..(553): n is a, c, g, or t
  modified_base (566)..(569): a, c, t, g, unknown or other
  misc_feature (566)..(569): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (590)..(590): a, c, t, g, unknown or other
  misc_feature (590)..(590): n is a, c, g, or t
  modified_base (593)..(594): a, c, t, g, unknown or other
  misc_feature (593)..(594): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
tcagatagagtactcacgaccggtgctcgatttagacgcgatcgaaggggctgggtgtgggtctcacgtattaatacgtgatgggactgacaccaatctacgcggactccgtgaagggccgattcaccccctccagagacaacgccaagaacacactatatctgcaaatgaacagtctgacgagcccgtaggaccacggctgtctattacngtgcaagaggtggctacaatcatggtttgatctctggggccaaggggacaatggtaccaccggtcctcgttcncgcctcccaaccaagggccccattccgggtctttccccccgtggccgtccccctgtccgtccaacggtacgccaacccgtcccgaagacgcaaccaggcccgggcccctaggggggccttcggacccgtgggtaccgaaacggtacccgttaacctttccgtaacttggtaacctttaccgtccgttaggaacggtccgggggtcgtaacggggaccgtaaacgggaccggtcctaaagtaccggatgtagtgacctnacnggttacanccgagccctatgnnnncananagtacgagacgtgagnacnncatntnctatntc

SEQ ID NO: 213700 - DNA, 592 bp, Homo sapiens
  misc_feature: GYAE6OF02HD66A.29.27.C05.1.454.CMB.1.raw
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(592): a, c, t, g, unknown or other
  misc_feature (562)..(592): n is a, c, g, or t
tcagatagagtactcacgaccggtgctcgatttagacgcgatcgaaggggctggtgtgggtctcacgtattaatagtgatgggactgacacaatctacgcggactccgtgaagggccgattcacccctcagagacaacgccaaagaacacactataatctgacaaatgaaacagtctgaagagccgaggacacggctgtactattactagtcgacaaaggnggttggaccttaanaaaagtctagttaggggttttnaatcgtcgtacgggggacctaaaggggactaaagttcgggactacccggttcttnttcagcccttcccaaacgaagggcccctagttacccggttcccttaccccgtggaccccgtcctaccggctcctaacgggacttccgaccgttacccgaagcgaccaacggagtccggcccgttagggcctgcccgtttaggactaaaacgggacctttaactccgttaagtacttgtaaccctgtacggaggccggggtacgttacgggacgtaaacggtcccggacttaacgaagcacgcngtnantnnnnnnnnnnnnnnnnnnnnnnnnnnnnnnn

SEQ ID NO: 213701 - DNA, 731 bp, Homo sapiens
  misc_feature: GYAE6OF02GC4BU.29.27.C05.1.454.CMB.1.raw
tcagatagagtactcacgaccggtgctcgatttagacgcgatcgaagggtttgggggaggaactgctcagttaggacccagagggaaccatggaagccccagctcagcttctcttcctacctgctactctggctcccagatgcctaccggagaagtgtgttagacacagtctccagccaccctgtcgtttgtctccgaaggggaagagcctaccttctcctgcagggccagtcagagtgttggcacctacatacgcctaggtaccaacgacgaaacctcggccaggcctaccccagggcctcccgtactatacctatgtatgcataccgaaaggcctacgtggcactcccgagaccgtagtcgagtcggcgtaggtgggtcgtacgggactaggtaccttcacctacctaccacccattaccgaacggttacgaccgtaacggacgtaccgtaggaagtttattttacggacgtttaacgtttacgtttacgtaggttactaggtacgtacggtacgtacgtacggtacggtacgggtccgggtcgggtccttacggttacccgggtttacgggaccgggggtaaacgggtacccggtaaagggtacggtaacgtaccgtaaacccggtaaacgggtaaccgttacggggtaaccggttaccgttacgggtaccctaacccgttaaccggttcccggtttaaccggtttaccttaccccgtttaaccccgg

SEQ ID NO: 213702 - DNA, 680 bp, Homo sapiens
  misc_feature: GYAE6OF02HBYCR.29.27.C05.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagatagagtactcacgaccggtgctcgatttagacgcgatcgaagggtttgggggaggaactgctcagttaggacccagagggaaccatggaagccccagctcagcttctcttcctcctgctactctggctcccagatcgccacggagaaagtgtgttgacacagtctccagcccaccctgtctttgtctccgaaggggaancgccaccttctcctgcaggccagtcagagttgtgcaccgtnatgcctaggtaccaacgagaaccgtcggacgacgcctaccgacgtcctaccgtacactacgtatgtatgacaacgtaaccgaaacggtccgtacgtcggacctaccgtcccgagacctaggtcgtacggcggtcgtagggtcgggtcgacgggacgacgtacgtacgactcctactacgatactagtactaccgtagactacgtagtacgttaagtttcgtaacgtttaacgtttattcgttagtacgtacgacgtacgtacggtacgtcggtacggtcgggtacgggtcgtacgttccgtacgggttcgggtaaccgggtaaccggaacgttaacgggtaacggtacgtaacggtaaaccgaaacggttacgttcgggtaccggtacgtaccgtaccgtacgtaccgtttcgttacgttacgtcccttacccgg

SEQ ID NO: 213703 - DNA, 600 bp, Homo sapiens
  misc_feature: GYAE6OF02ISVDB.29.27.C05.1.454.CMB.1.raw
  modified_base (209)..(209): a, c, t, g, unknown or other
  misc_feature (209)..(209): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(575): a, c, t, g, unknown or other
  misc_feature (572)..(575): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (582)..(583): a, c, t, g, unknown or other
  misc_feature (582)..(583): n is a, c, g, or t
  modified_base (585)..(586): a, c, t, g, unknown or other
  misc_feature (585)..(586): n is a, c, g, or t
  modified_base (588)..(596): a, c, t, g, unknown or other
  misc_feature (588)..(596): n is a, c, g, or t
  modified_base (598)..(599): a, c, t, g, unknown or other
  misc_feature (598)..(599): n is a, c, g, or t
tcagatagagtactcacgaccggtgctcgatttagacgcgatcgaaggggctgggtgtgggtctcacgtattaatagtgatgggactgacacaatctacgcggactccgtgaagggccattcaccccctcagacgacaacgccaagaacacactatatctgcaaatgaacagtctgagacgccgaggacacggctgtctattactggtnacaagaggtggctaacaattcagttggttttagattcgtcgtggggaccaaagggactaacgtcggcctaccggttctacgttcgacggcccttaccgaaccgaaaccggggcccctaaggttccccggttcccgtttccccccggtgggccccgtacccctggtccctaccgggacgggtacgaccctacccgtcggagtacgaccaaccgtacggcccggtccgtacgggccttcggcccgtaggtaccgaaggtacccttaacgttccgtaaagttcggttaactccgtcggtggaccgggtcggacgtcggacgtaacggcgtacaggtacgncngcncnncnacgtngtgacgngngnnnngncgncnngnncnnnnnnnnncnnc

SEQ ID NO: 213704 - DNA, 662 bp, Homo sapiens
  misc_feature: GYAE6OF01CVAMF.33.71.G05.1.454.CMB.1.raw
  modified_base (224)..(224): a, c, t, g, unknown or other
  misc_feature (224)..(224): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagtacacacactcacgaccggtgctcgatttagtgtcgtcgcaagagagagggggctgtaggctcaggaggcagagctctgaatgtctcaccatggcctggatccctctcctgctccccctctcactctctgcacagtctctgtggcctcctatgagctgagacagccatcctcagtgtcagtgtctccgggacagacaaccaggactcacctgctcaaggnatctattgaacgaaagatcattgttcggtgttccagcagaacgcccggccacggccctgtgtggtntatttangaagtatttacgaacggggtctacgagggtactcccgtgacgcgtactttctcccgtcctcctactcctacgtaacgggtaacccacgttcggtacctaacccgtttcgaaccctagtaccggaacgggacccgggggtaccccgtaaggggtttcggaacgggtagttacgggtaacgggtacttacgtaacgtttaacgtttacttttacggtttaacctcgttacggtacgtacgtacgtaacggtaacgttaaggtttcgggggtttacggacgggtacgggtacctagggttctacggtacccgttaccgtaaggtccgaacgtaccccgaacgtccgtacccggtccccctggtacccg

SEQ ID NO: 213705 - DNA, 575 bp, Homo sapiens
  misc_feature: GYAE6OF01CMWWT.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtggcctcctatgagctgagacagccatcctcagtgtcagtgtctccgggacagacaaccaggatcacctgctcaggagatctattgacgaaagatcatgttcggtggttccagcagaagccggccaggccctgtgtggtgtatttatgaagtattttcgaacggggtctcgaggggtactcccgtgagcgtattcgtccgcctccatcctcgacgggaccactcgtcctaccttgacctatcgacggccggggccctagggttcgaggagtggaggctgacttattattgttactctgacgtactgacgtacgtagttcggggtttcggacgggtacgggtaccgtacggtccgtacggtacccggttccgtaacggtccgaccggtaccccgaacggtcccgtcccggccccccgttcgggtaccccg

SEQ ID NO: 213706 - DNA, 624 bp, Homo sapiens
  misc_feature: GYAE6OF01BNR1Q.33.71.G05.1.454.CMB.1.raw
  modified_base (225)..(225): a, c, t, g, unknown or other
  misc_feature (225)..(225): n is a, c, g, or t
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtggcctcctatgagctgagacagccatcctcagtgtcagtgtctccgggacagacaaccaggatcacctgctcgagganatctattgaacgaaagatcatgttcggtggttccagcagaacgcccggccacggtccctgtgttggtgtatttatgtaagtattttacgaacgggtctcgaggactccgtgacgcgtattccgtccgtcctccactccgtcgacgggaccctacgtcgtacctaccgttcgaccctagtaccgacggccggggaccctagggttcggaaggtagtcggtacggtcgtgtaacgttatttacgtttcgttactcgttggaccgtacgttacgaacgtaaccgtaggtttcgggggtttcggacgggtacgggaccgttacggtccgtacggtacccggttaccgtaacgtcccgaaccggtacccggaacggtcccgtcccggtcccccgtcggtacccg

SEQ ID NO: 213707 - DNA, 695 bp, Homo sapiens
  misc_feature: GYAE6OF01A804A.33.71.G05.1.454.CMB.1.raw
tcagtacacacactcacgaccggtgctcgatttagtgtcgtcgcaagagagaggggggctgtaggctcaggaggcagagctctgaatgtctcaccatgacctggatccctctcctgctccccctctcactctctgcacagtctctgtggcctcctatgagctgagacagccatcctcagtgtcagtgtctccgggacagacaaccaggatcacctgctcaggagatctattgaacgaaagatcatgttcggtggttccagcagaacgccccggccacggcccctgtgttggtgtatttatgaagtattttacgaacgggtctcgagggtactcccgtgacgcgtattcctccgcctccatctcgacgggacctacgtcgtacctaccttcgacctactccgacgggcccggggcccgtaagggttcggaagggtagtcggacggtccgttaggtaactttaagtttacgtttaggtttaccttccgttacggtaccgtaaccgttacggtaaccggtaacggttaacgggtttcggggggttttaccgggacggggtaacggggtacccgttaacgggttccgttaaccgggtaccccggttaacccggttaaacgggttacccgtaacccgggtaacccccggtaaacgggtacccccgttccccgggtcccccccggttccgggttacccccg

SEQ ID NO: 213708 - DNA, 887 bp, Homo sapiens
  misc_feature: GYAE6OF01DM6SO.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgcctccccctctcactctctgcacagtctctgtcggccctcctatgagctgagacacgccatcctcagtgtacagtcgtccgtccgggaacaacgaaccaaaccgaggactccaccgtgctacgaggtagtactactagttaggaacgaaagtactactagttcggttacggtcgttccgagcgaaggaaccgccccggaccgaccggtcccgtggttcggttggttagttaacgtttagtagtaaacgttacgttttaccggaacgggtccttacggacggtacttccgtagacgtacgtacttcccgtccgtccttacgtactccgtacgacggtacctacgtccgtaccgtacccgtacgaacctacgtaccggtacccgggtacccggggtaacccgttaaggggttacgggaacggttacggtacgggtaaccggtacgttaaccggttaaacgttttaacgttttaacgttttacgggtttaacccgttacggttaccgggttaaccggtaaccgttaacgggttaaacccggtttaaccgggtttaaccgggggttttaccggggggtttaaccggggtaaccgggggtaaaacccgggttaaccgggttaaccggtttaacccgggttaaccgggttaaacccccggttaaacccggtttaaaccgggtaacccccggtaaaccccgggtaaccccggttaaccggggttacccccgttaacccccccggtttcccccgggtttaaccggtttaaaccccccgg

SEQ ID NO: 213709 - DNA, 865 bp, Homo sapiens
  misc_feature: GYAE6OF01ES5G6.33.71.G05.1.454.CMB.1.raw
  modified_base (170)..(170): a, c, t, g, unknown or other
  misc_feature (170)..(170): n is a, c, g, or t
tcagtacacacactcacgaccggtgctcgatttagtgtcgtcgcaagagagaggggggctgtaggctcaggaggcagagctctgaatgtctcaccatgacctggactccctctcctgctccccctctcactctctgcacagtctctgtcggcctcctatgagctgagacngccatcctcgagtgtcaggtgtccgtaccgggacaacgaaccaaaccgaggaacttccaacccgttgaccttacggaaaggtacgtacttcgttaattacgaaacggtaaaagtacttacctaagttcggtttcgggttcggttaccaacggacgaaacggaaccggccccggtaccgaccgggtcccccgttgggttcggtttcgggttacgttaatttaagtaggtaaacgtttacgttttaaccggaacgggtccgtacggacgggtacgtaccccgtaggtacggtaccgtactttcccggtaccccgtccctaccgtacgttacccgtaccggtaacgggtaaccctaccgtttcggtacccttacccgtttacgaacccttagaccgggtaccggtacccgggtacccggttagggtaacggaacggtagtaacgggtaccggtacgtacggtaaccgttttaagttcgttttacggttaaccgttaccgttacggtaacgaccggttaacgtaaaccggtaacggtaaacgggtttcggggtaacgggttacccggggtaacggggtaaaccgggtaacggttaaacgggtttaacccggtaaccccggttaccgttaaacggtacccgaacccggttacccggaaaccggttccgtacccccggtccccccggttggttaaccccgg

SEQ ID NO: 213710 - DNA, 667 bp, Homo sapiens
  misc_feature: GYAE6OF01AE9L9.33.71.G05.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtggcctcctatgagctgagacagccatcctcagtgtcagtgtctccggganagacaaccaggatccacctgctcagganatctattgacgaaagatcatgttcggtgttccagcagaacgcccggcacggcccctgtcgttggtcgtattttatgtaagtattttacgaacggggtctcgagggtactcccgtgagcgtattccgtccgtcctcctactcgtcgacggacctacgtcgtcctaccttgaccatccgacggccggggtaccctagggtttcgaacgggtagtaggacgggtctacggttaacttagttttaagtttcgttaccgttaccgtcggtaccgtaacgttacggaacgtaccgttaacgggtttcgggggttttaccgggacggggtaacgggtacccgtacggttaccgtacggtaacccgttacccgttaaacggttacccgaaacggtcccccgtaaacgggtccccgttacccggtcccccccggttccgggttaacccccg

SEQ ID NO: 213711 - DNA, 766 bp, Homo sapiens
  misc_feature: GYAE6OF01DOIOL.33.71.G05.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
tcagtacacacactcacgaccggtgctcgatttagtgtcgtcgcaagagagagggggctgtaggctcaggaggcagagctctgaatgtctcaccatggcctggatccctctcctgctccccctctcactctctgcacagtctctgtgcctcctatgagctgagacagccatcctcagtgtcagtgtcctccgggacagacaaccgagactcacctgcctnaggntatctatagaacgaagatcatgttcggtgttcagcagacgccgcgacgtccctgtcgtgtntattatgtagtatttcgacgggtctagacggtactccgtgacgcgtacttcctccgacctcactccgtacgacggaccctacgtcgtacctacccgttacgaacccgtacgtaccggtaccgggtacccggggtaaccccgttaggggtttaacggacggggtaacgttacgggaaccggttccgttaacggttaaaccgtttaagtttttaacgttttaccggttttaaccgttcccgttacggtaacccgggttaccgttaaaccggtaaccgggtttaaaccggtttaacgggggttttaccggggggtttttaacccgggggaacggggttaaaccccggggtaaaccggttaaccgggttcccggttaacgggttaaccccggttacccggttaaacccggttcccgtaaccccgggtaacccgtaaaccggggtcccgttaacccccggttcccccggttacccgggttaccccg

SEQ ID NO: 213712 - DNA, 717 bp, Homo sapiens
  misc_feature: GYAE6OF01E2T7E.33.71.G05.1.454.CMB.1.raw
  modified_base (364)..(364): a, c, t, g, unknown or other
  misc_feature (364)..(364): n is a, c, g, or t
tcagtacacacactcacgaccggtgctcgatttagtgtcgtcgcaagagagaggggggctgtaggctcaggaggcagagctctgaatgtctcaccatggcctggatccctctcctgcctccccctctcactctctgcacagtctctgtgcctcctatgagctgagacagccatcctcagtgtcagtcgtccgtccgggacagaccaaccgaggactccacctgctcgaggagatctattgaacgaaagatcattgttcggtgttcagcagacgcccggcgacgcccgtgtgttggtatattagtagtaagttagtttacgaacgggtctacgagggtactccgtgacgtcgtacgttccgtccnccctctactccgtacgacggtaccctactcgtacctacccgttacgaaccctagtaccggacgggcccggggtacccgtagggttacggacgggtagtcggacggtcttaagtacgttttaacgtttacgtttacggtttaacccttcggtacccggtaccgtaaacggttacccgggaaacggttaacccggggtttaacgggggttttccggggaccggggtaccgggtaaaccggtaccggttaccggtaccggtaacccggttacccggtaacggtaaccgacccggtaaccccgtaccggtacccggttacccccggtccccccgttacccggtccgttaacccccgg

SEQ ID NO: 213713 - DNA, 669 bp, Homo sapiens
  misc_feature: GYAE6OF01ELLMX.33.71.G05.1.454.CMB.1.raw
  modified_base (200)..(200): a, c, t, g, unknown or other
  misc_feature (200)..(200): n is a, c, g, or t
tcagtacacacactcacgaccggtgctcgatttagtgtcgtcgcaagagagaggggggctgtaggctcaggaggcagagctctgaatgtctcaccatgacctggatccctctcctgcctccccctctcactctctgcacagtctctgtcggcctcctatgagctgagacagccatcctcagtgtcagtgtcgtccggganagacaaccaggactcacctgctacgaggatatctatagaacgaaagatctagttgttcggtcgttcagcagaccgccggcacgcccgtgtcgttggtagtatttagtagtaagtagtttacggacgggtctacggaacggtctccgtaggacgtcgtactttccgcccgtccctaccgactccgtacgaacggacctacgttcgtaccgtaccgttacgaacctacggtaccgacgggtacccgggaccgttacgggttacggaaggttacggtacggaccggtattacggtaaaccttttagtttacgtttacgtttacctcggtacgtaccgtacgttacgtacgtaacgttaggggtttccgggttcgggaacgggtacggtaaccgttggtaccggtacgtaccggtaccgttaaggtacccgaccgtacccgaacggtcccgttcccggtccccgtcgtacccg

SEQ ID NO: 213714 - DNA, 690 bp, Homo sapiens
  misc_feature: GYAE6OF01EN3BS.33.71.G05.1.454.CMB.1.raw
  modified_base (202)..(202): a, c, t, g, unknown or other
  misc_feature (202)..(202): n is a, c, g, or t
tcagtacacacactcacgaccggtgctcgatttagtgtcgtcgcaagagagaggggggctgtaggctcaggaggcagagctctgaatgtctcaccatggcctggatcccctctcctgcctccccctctcactctctgcacagtctctgtggccctcctatgagctgagacagccatcctcagtgtcagtgtccgtccggganagaaccaaccgaggactccacctgcctcgaggagattctattgaacgaaagatcagttggttcggtcgttccagcaagaacggccccgccgaccggtcccctggtggttggtgtatttagtagtaagttagttttaccggaacgggtctacggacggtctccgtgacgtcgtacttcctcccgtcctacctactctaccgacggtaccctacgttcgtacctaccgttaccgacctacgtaccggtacgggcccggggtacccgtaagggttaggaacggtagtagggtaccggtcgtaacgttaacgtttaacgttttacgtttaccgttaccgttccggttacggtaccgtaacgttaccggtaaccgttaacggttaacgggtttcgggggtttaccggacgggtaccggtaccgtacggtccgtacggtacccgtactacgtacgacccggtaccgtacgtccctcccgtccccgtcggtaccc

SEQ ID NO: 213715 - DNA, 945 bp, Homo sapiens
  misc_feature: GYAE6OF01B3HBB.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgcctccccctctcactctctgcacagtctctgtcggcctcctatgagctgagacagccatcctcagtcgtcaggtgtccgtaccggggacaggacctaaccgaggactccacccgtgacctcgaaggagtacttacgttattagtaaccgaaaagtacgtacctagttacggtttccggttggtttaccaacggacgtaaacgggtaaccggaccccccgggtaccccgaaccggggttccccccgttaggtttacgggttttacggggttacgttaaacgtttttaagtaaacgggtaaaacggtttaacgttttttaaccgggaaaccggggtacccgttacggtaaacggggggtacctttaccccgtagggtaacgggtaccggttaacccgtttcccgtacccccgtaccgttaacccctagtttaccccgttaccggggaaaccccggggtaaccccgttaaccggtttacccgggttacccgttaaacccgtttacccccggggtaaaccttaaccggtacccgggtaacccgggggttaccccgggggggtacccccttaaaggggggttttaaccgggaaacgggtttaccggtaacggggttaaccgggtccggttaaacgggtttaaacccctttaaggttttaaccggttttacgtttacccgttacggttcggtaaccggttaccgtaaacggtaaccggttaaccgtaacggggtttccgggggtttaaccggaccggggtaaccggacgttacggtcgtacgacccggttagtaacgcccacgtaaccgacgcgttcccggccccgttcggtacc

SEQ ID NO: 213716 - DNA, 552 bp, Homo sapiens
  misc_feature: GYAE6OF02IQ6AM.33.71.G05.1.454.CMB.1.raw
  modified_base (225)..(225): a, c, t, g, unknown or other
  misc_feature (225)..(225): n is a, c, g, or t
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtggcctcctatgagctgagacagccatcctcagtgtcagtgtctccgggacagacaaccaggatccacctgctcagganatctattgacgaaagatcatgttcggtgttccagcagaagcccggccaggcccctgtgttggtgatttatgaagtattttcgaaacgggggtctacgagggtactccccgtgacgcgtattctccgcctccatctcgacgggaccactcgtcaccgttcgaccatcacggccggggcccaggttgacggtatggaggcgtagacgtatttagttcgttactcgtgcgtacgtgaacgaactaagttggggttttacggcgggtacgggactaggtcgtggaccgtacgtaagtcgacgtcccgaaggcctcggcccccgtggtaccc

SEQ ID NO: 213717 - DNA, 520 bp, Homo sapiens
  misc_feature: GYAE6OF02FTISR.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgctccccctcctcactctctgcacagtctctgtggcctcctatgagctgagacagccatcctcagtgtcagtgtctccgggacagacaaccaggatcacctgctcaggagatctattgacgaaagatcatgttcggtggttccagcagaagcccggccaggccccctgtgttggtgatttatgaagattttcaacggggctcagggatccctgagcgattctcgcctccatctcaggaccactgtcaccttgaccatcagccgggcccaggttgaggatggaggctgactattattgttactctgcgactgacgacaagttggggttttcggcggtagggacctaggtctaggacccgtccttaagtcctacgccccgaaggtcctcggccccccgtggtacccg

SEQ ID NO: 213718 - DNA, 546 bp, Homo sapiens
  misc_feature: GYAE6OF02IYFHR.33.71.G05.1.454.CMB.1.raw
tcagtacacacactcacgaccggtgctcgatttagtgtcgtcgcaagagagaggggggctgtaggctcaggaggcagagctctgaatgtctcaccatgacctggatccctctcctgctccccctctcactctctgcacagtctctgtggcctcctatgagctgagacagccatcctcagtgtcagtgtctccgggacagacaaccaggatcacctgctcaggagatctattgacgaaagatcatgttcggtggttccagcagaagcccggccaggcccctgtcggttggtgattttatgaagtatttttcaacggggtctcaggggtatccctgagcgattctccgcctcatctcaggaccactgtccaccttgaccatcagcggggcccaggttgaggatggaggctgactattattgttactctgcgtactggaaccgtactaaaggttggggtttcggcgggagggtacccgtaggtccgtcggtaaccgttccgttaagtccgaacggcccgtaagggcctcccggccccctccggtacccg

SEQ ID NO: 213719 - DNA, 530 bp, Homo sapiens
  misc_feature: GYAE6OF02GN8XP.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgctccccctcctcactctctgcacagtctctgtggcctcctatgagctgagacagccatcctcagtgtcagtgtctccgggacagacaaccaggatcacctgctcaggagatctattgacgaaagatcataagttcggtggttccagcagaagcccggccaggcccctgtgttggtgatttatgtaagtattttcgaacggggtctcgaggggactcccgtgagcgatttctccgcctcatctcaggaccactcgtcaccttcgaccatcagcgggcccaggttgaggatggagctgactattattgttactctgcgtactgacgactagttcggggtttcggcggtaggacctaggtctacggtaccgtaccgtaacgtcgacgcccgaaggtcctcgtcccccgtcggtaccc

SEQ ID NO: 213720 - DNA, 554 bp, Homo sapiens
  misc_feature: GYAE6OF02F7MW9.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtggcctcctatgagctgagacagccatcctcagtgtcagtgtctccgggacagacaaccaggatcacctgctcaggagatctattgacgaaagatcatgttcggtgttccagcagaagcccggccacggcccctgtcgttggtgtatttatgaagtattttcgaacggggtctcgagggtactcccgtgagcgtattctccgcctccatctcgagggaccacgtcgtcaccttgaccatcgacggccggggcccagggttcggaggtagtggaggtcgtgacgttatttagttgttactcgtgacgtacgtgacgtaacgtaagttcggggtttacggcgggtaggaccgtaggtcgtacgtaccgtaccgtaagtcgacgtcccgaaggctccgccccgtcggtccc

SEQ ID NO: 213721 - DNA, 691 bp, Homo sapiens
  misc_feature: GYAE6OF02JB7R0.33.71.G05.1.454.CMB.1.raw
  modified_base (225)..(225): a, c, t, g, unknown or other
  misc_feature (225)..(225): n is a, c, g, or t
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtggcctcctatgagctgagacagccatcctcagtgtcagtgtctccgggacagacaaccaggactcacctgctcagganatctattgacgaaagatcatgttcggtggttccagcagaacgcccggccacggccccgtgtcggttggtgatttatgaagtattttcgaacggggtctacgagggactcccgtgagcgtattcctccgcccttcactcctacgacggggaccctacgtcgtacctacccgtttacgaccctacgtcgacggtccgggggaccctagggtttcggaacgggtacgttacggacgggtacttacggtaactttacgtttaatttacggtttaccttacgttacggtaccttaacgtacggtaaccgtaacgttaaacggtttcggggggtttttaccgggacggggttacggggtaacccgtacgggtttacgtaccggtaacccggttaacccgttaacggttcccgtaaccggaccccgttaaacgggtccccgttacccggtaccccccggttcggttaaccccg

SEQ ID NO: 213722 - DNA, 614 bp, Homo sapiens
  misc_feature: GYAE6OF02FQ3D6.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgctccccctcctcactctctgcacagtctctgtggcctcctatgagctgagacagccatcctcagtgtcagtgtctccgggacagacaaccaggactcacctgctcaggagatctattgacgaaagatcatgttcggtggttccagcagaacgcccggccacggcccctggtgttggtgtatttatagaagtagttttcgaacggggtctcgagggactccctgacgcgtattcctcgcctcatctcgacggtaccacgtcgtcctacctcgacctctcgacggccgggacccgtaggttggaggagtaggagcgtgtacttatttagttacgttacgtcgtcggtaccgtacgtacgtacgtaacgtaacgggtttcgggggtttaccgggacgggtacggggtaccgtagggttcccgtacggtacccgttaccgtaacggtacccgaccggtacccgaacgggtcccgtcccggtcccccggttccggttaccccg

SEQ ID NO: 213723 - DNA, 658 bp, Homo sapiens
  misc_feature: GYAE6OF02GY14L.33.71.G05.1.454.CMB.1.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtggcctcctatgagctgagacagccatcctcagtgtcagtgtctccgggacagacaaccaggatcacctgctcaggagatctattgacgaagatcatgttcgtggtcancagagcccgcagccctgtgttggtntatttatgaagtattttcgaacggggtctcgagggactcccgtgagcgtattcctccgcctccatctcgacgggaccactcgtcctaccttcgaaccatcgaacggtcccggggtaccctaggggtttacggagggtagttacggacgggtaccttaggtaaccgtttatttacgtttacggtttaaccttcgttacggtaccggtaacttacggtaaccgtaacgtaaggttttcggggggttttaccgggaccggggtacggggtaccgtaacgggttccggtaccggtaacccggttaaccgttaacggttaccgaaccggtaccccgggtaaacggtcccgtaccccggtcccccccgttacggggttaccccc

SEQ ID NO: 213724 - DNA, 843 bp, Homo sapiens
  misc_feature: GYAE6OF02IKXOU.33.71.G05.1.454.CMB.1.raw
  modified_base (231)..(231): a, c, t, g, unknown or other
  misc_feature (231)..(231): n is a, c, g, or t
tcagtacacacactcacgaccggtgctcgatttagtgtcgtcgcaagagagaggggggctgtaggctcaggaggcagagctctgaatgtctcaccatggcctggatccctctcctgcctccccctctcactctctgcacagtctctgtggcctcctatgagctgagacagccatcctcagtgtcagtgtcgtccgggacagaccaaccaggactccacctgctacgagganactctagttagaacgaaagtatactaagttcggtttccgggttcggttaccgaacggaccgaaacggaaaccggcccccgggacccgtaacccgggttccccgttagggttcgggttttcgggtacggttaacgttttaacgtaaggttaaaacggtttacgttttaaccgggaacgggggttcctacggaacgggtaccttcccgtaggtaacgtacgtacgtttacccgtcccgtacccttaccgtacgttccgtaacggaaccgggtaaccctacgttacgtaccgtacccgttacgaaccctacgtaccggaccgggtacccggggtacccgtaagggttacggaacggtacgttacgggtacggtaccgttagttaaccgtttacgtttaacgtttacgtttaaccttcggttaccggtaccgttaaccgttaaccggtaaccgtaaaccggtttaacggggttttcgggggtttaacccggggacggggtaccgggtaccttacgggttccgttaacccggtaacccgttaaccgtaacggtaaccgtacccggtaaccggtaaccggtcccggtacccggttaccccccggttaggttaaccccg

SEQ ID NO: 213725 - DNA, 716 bp, Homo sapiens
  misc_feature: GYAE6OF02I6ZR6.33.71.G05.1.454.CMB.1.raw
tcagtacacacactcacgaccggtgctcgatttagtgtcgtcgcaagagagaggggggctgtaggctcaggaggcagagctctgaatgtctcaccatggcctggatccctctcctgcctccccctctcactctctgcacagtctctgtgcctctatgagctgagacagccatcctcagtgtcagtcgtcgtaccgggacagaccaaccgaggtactccacctgcctacgaggactatccgtattacgaacgaaagtatactagttcggttcggtagttaccaagacgtacggaaaccgccccggaccgtacggtccccgtggttcggttaggtattacgttttaagtacggtaaacgtttacgttttaccggaaacggggttccttacggtaaacggggtaccttaccccggtaagggtaacggtccggttaaccgtttccccggtcccggtaccctacccgtaacgtttcccgtaccggaacgggtaccctaacgttcggtaaccctaccgttaccgaacgtcgtaccgacgggccgggtaccgttaggttacgacggtagttacgacggtcgtaacggtacttagtttaacgtgttaacctgtccgagttaccgagtacgtaacgtaggttcgggtacggtcggacggtactagtacgtacgtaccgttacgagtacgacggtaccgaaggtcccgtaccgtacccgtcgtacg

SEQ ID NO: 213726 - DNA, 844 bp, Homo sapiens
  misc_feature: GYAE6OF02GSAI0.33.71.G05.1.454.CMB.1.raw
  modified_base (239)..(239): a, c, t, g, unknown or other
  misc_feature (239)..(239): n is a, c, g, or t
tcagtacacacactcacgaccggtgctcgatttagtgtcgtcgcaagagagaggggggctgtaggctcaggaggcagagctctgaatgtctcaccatggcctggatccctctcctgctccccctctcactctctgcacagtctctgtcggcctcctatgagctgagacagcccagtccctcagtcgtcagtcgtccgtccgggacagaccaaccgaggactccacctgcctcgaagganacttctaagttacggaacgaaagtctacgtagttcggtttcgggttacggttaccaacggtaccgaacggtaaccggaccccgggtacccggaacccggtcccccggttgggtttaccgggtttcggttaggttaacgttttaacgttaggtaaacgtttaaccggtttttaaccgggaaccgggggtaccttaccggaacggggttacccgttcccggtaagggtacggtaccgttaacgtttccccgttaccccggacccttaccgtaccgtcccgttaaccggaaccgggtaccctaccgtttactacccgttaacccgtttacgtaacccgtaacgtcccggaccggggtaccccggggtacccggttagggttacggtaacggttaccggtacgggtacgggttacgtaacgttaacgttttaacgtttacgtttacgttaccgtcgtaccggtccgtaacgtcggtaacgtaacggttagggtttaccggggtttaccgacggggtacggtaccgtacggttccgttaacccgtacccggttaacgttaccgtaaccgaccgacccggtacggtccctacccggtccccgtcgtacccg

SEQ ID NO: 213727 - DNA, 769 bp, Homo sapiens
  misc_feature: GYAE6OF02GGHUA.33.71.G05.1.454.CMB.1.raw
  modified_base (183)..(183): a, c, t, g, unknown or other
  misc_feature (183)..(183): n is a, c, g, or t
  modified_base (761)..(761): a, c, t, g, unknown or other
  misc_feature (761)..(761): n is a, c, g, or t
tcagtacacacactcacgaccggtgctcgatttagtgtcgtcgcaagagagaggggggctgtaggctcaggaggcagagctctgaatgtctcaccatggcctggactccctctcctgcctccccctactcactctctgcacagtctctgtcgccttcctatcgagctagagacagccattccnctagtgtcaggttgtccgtaccgggaacagaaccaaaccggaggactcctaccgtggacctacggaacggtactacttcttaagttacggaaaccgtaaagactactaagtttcggttacggttggttaccagtacacggaacggtccccggacgaccgggtccccttggttcggttacggttagttaagttttaagtaacggtaacgtttaacgttttaccggaaccgggggttacctacgggaccggtacgttcccgttaggaacggtccgttaagtttcccgtcccgtccttaccctagttaccctcgggtaaaccggacctacgttaccgttaccgtccctttacgacctacgtcggaacggtcccggggtacgttaacggtcgggtaacggtacgttacgggacgtacggttacttaacgtttaattttacgtttacgttaaccgtgtccgtacggtacgacggtacgtacgttaagggttttcggggtaccggcgggtacggtacgtacggttcggtaaccgttaccgggtaaccttacgacgtacgccgtaacggtcccacccggttcccnccgtaccg

SEQ ID NO: 213728 - DNA, 144 bp, Homo sapiens
  misc_feature: GYAE6OF01D9010.1.25.C03.1.454.CMB.1.raw
tcagacgagtgcgtcacgaccggtgctcgattagtagtgtagattggttggaaggaggagactgacggtcctgccacagcggcctggctgcctggtcaaggactacttccacgcactcgtctgagcggctggcaaggcgcatag

SEQ ID NO: 213729 - DNA, 155 bp, Homo sapiens
  misc_feature: GYAE6OF01CT9XY.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagactgacggtcctgccacagcggccctgggctgcctggtcaaggactacttccagtactctatctgagcgggctggcaaggcgcatagn

SEQ ID NO: 213730 - DNA, 155 bp, Homo sapiens; identical to SEQ ID NO: 213729
  misc_feature: GYAE6OF01BLX1V.1.25.C03.1.454.CMB.1.raw
  modified_base (155)..(155): a, c, t, g, unknown or other
  misc_feature (155)..(155): n is a, c, g, or t

SEQ ID NO: 213731 - DNA, 155 bp, Homo sapiens; identical to SEQ ID NO: 213729
  misc_feature: GYAE6OF01BT3IP.1.25.C03.1.454.CMB.1.raw
  modified_base (155)..(155): a, c, t, g, unknown or other
  misc_feature (155)..(155): n is a, c, g, or t

SEQ ID NO: 213732 - DNA, 162 bp, Homo sapiens
  misc_feature: GYAE6OF01A0AFB.1.25.C03.1.454.CMB.1.raw
  modified_base (156)..(162): a, c, t, g, unknown or other
  misc_feature (156)..(162): n is a, c, g, or t
tcagacgagtgcgtcacgaccggtgctcgatttagtagtgtagatttgggtttgggggaaggaggaagactgacggtcctgccacagcggccctgggctgcctggtcaaggactacttccctacagtgctctgagcgggctggcaaggcgcatagnnnnnnn

SEQ ID NO: 213733 - DNA, 255 bp, Homo sapiens
  misc_feature: GYAE6OF01DEY1R.1.25.C03.1.454.CMB.1.raw
  modified_base (252)..(255): a, c, t, g, unknown or other
  misc_feature (252)..(255): n is a, c, g, or t
tcagacgagtgcgtcacgaccggtgctcgatttagtagtgtagatttgggtttgggacagacttcactctcaccatcagcagactggagcctgaagatttgcagtctattactgtcagcagtatggtaggtcacccctggcgttcggccaagggaccaaggtggaaatcaaacgaactgtggctgcaccatctgtcttcatcttcccaccctcctcacgcactcgtctgagcgggctggcaaggcgcatagnnnn

SEQ ID NO: 213734 - DNA, 154 bp, Homo sapiens
  misc_feature: GYAE6OF01C0RB1.1.25.C03.1.454.CMB.1.raw
  modified_base (152)..(154): a, c, t, g, unknown or other
  misc_feature (152)..(154): n is a, c, g, or t
tcagacgagtgcgtcacgaccggtgctcgatttagtagtgtagattgggttggggaagaggaagactgacggtcctgccacagcggccctgggctgcctggtcaaggactacttccctacagtgctctgagcgggctggcaaggcgcatagnnn

SEQ ID NO: 213735 - DNA, 168 bp, Homo sapiens
  misc_feature: GYAE6OF01ATKQ4.1.25.C03.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtagtgtagatttgggtttgggggaagaggaagactgacggtcctgccacagcggccctgggctgcctggtcaaggactacttccagtactctatctgagcgggctggcaaggcgcatagnnnnnnnnnnnnnn

SEQ ID NO: 213736 - DNA, 155 bp, Homo sapiens; identical to SEQ ID NO: 213729
  misc_feature: GYAE6OF01DZ13F.1.25.C03.1.454.CMB.1.raw
  modified_base (155)..(155): a, c, t, g, unknown or other
  misc_feature (155)..(155): n is a, c, g, or t

SEQ ID NO: 213737 - DNA, 154 bp, Homo sapiens
  misc_feature: GYAE6OF01CZTD3.1.25.C03.1.454.CMB.1.raw
tcagacgagtgcgtcacgaccggtgctcgatttagtagtgtagatttgggtttgggggaagaggaagactgacggtcctgccacagcggccctgggctgcctggtcaaggactacttccacgcactcgtctgagcgggctggcaaggcgcatag

SEQ ID NO: 213738 - DNA, 217 bp, Homo sapiens
  misc_feature: GYAE6OF01AQLJ5.1.25.C03.1.454.CMB.1.raw
  modified_base (157)..(159): a, c, t, g, unknown or other
  misc_feature (157)..(159): n is a, c, g, or t
  modified_base (161)..(161): a, c, t, g, unknown or other
  misc_feature (161)..(161): n is a, c, g, or t
  modified_base (163)..(165): a, c, t, g, unknown or other
  misc_feature (163)..(165): n is a, c, g, or t
  modified_base (168)..(168): a, c, t, g, unknown or other
  misc_feature (168)..(168): n is a, c, g, or t
  modified_base (170)..(217): a, c, t, g, unknown or other
  misc_feature (170)..(217): n is a, c, g, or t
tcagacgagtgcgtcacgaccggtgctcgatttagtagtgtagatttgggtttgggggaagaggaagactggacggtcctgccacagcggccctgggctgcctggtcaaggctacttccacgcactcggtctgagcgggctggcaaggcgcataggnnntnannnatnannnnnnnnnnnnnnnnnnnnnnnnnnnnnnnnnnnnnnnnnnnnnnnn

SEQ ID NO: 213739 - DNA, 156 bp, Homo sapiens
  misc_feature: GYAE6OF01ECSU5.1.25.C03.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtagtgtagatttgggtttgggggaagaggaagactgacggtcctgccacagcggccctgggctgcctggtcaaggactacttccctacagtgctctgagcgggctggcaaggcgcatagnn

SEQ ID NO: 213740 - DNA, 155 bp, Homo sapiens
  misc_feature: GYAE6OF01E2B81.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagactgacggtcctgccacagcggccctgggctgcctggtcaaggactacttccacgcactcgtctgagcgggctggcaaggcgcatagn

SEQ ID NO: 213741 - DNA, 156 bp, Homo sapiens; identical to SEQ ID NO: 213739
  misc_feature: GYAE6OF01EKURZ.1.25.C03.1.454.CMB.1.raw
  modified_base (155)..(156): a, c, t, g, unknown or other
  misc_feature (155)..(156): n is a, c, g, or t

SEQ ID NO: 213742 - DNA, 174 bp, Homo sapiens
  misc_feature: GYAE6OF01DDTO5.1.25.C03.1.454.CMB.1.raw
  modified_base (157)..(174): a, c, t, g, unknown or other
  misc_feature (157)..(174): n is a, c, g, or t
tcagacgagtgcgtcacgaccggtgctcgatttagtagtgtagatttgggtttggggggaaggaggaagactgacggtcctgccacagcggccctgggctgcctggtcaaggactacttccagtactctatctgagcgggctggcaaggcgcatagnnnnnnnnnnnnnnnnnn

SEQ ID NO: 213743 - DNA, 158 bp, Homo sapiens
  misc_feature: GYAE6OF01BNIPK.1.25.C03.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtagtgtagatttgggtttgggggaagaggaagactgacggtcctgccacagcggccctgggctgcctggtcaaggactacttccacgcactcgtctgagcgggctggcaaggcgcatagnnnn

SEQ ID NO: 213744 - DNA, 154 bp, Homo sapiens
  misc_feature: GYAE6OF01AHAAR.1.25.C03.1.454.CMB.1.raw
tcagacgagtgcgtcacgaccggtgctcgatttagtagtgtagatttgggtttgggggaagaggaagactgacggtcctgccacagcggccctgggctgcctggtcaaggactacttccagtactctatctgagcgggctggcaaggcgcatag

SEQ ID NO: 213745 - DNA, 186 bp, Homo sapiens
  misc_feature: GYAE6OF01DDNOU.1.25.C03.1.454.CMB.1.raw
  modified_base (157)..(186): a, c, t, g, unknown or other
  misc_feature (157)..(186): n is a, c, g, or t
tcagacgagtgcgtcacgaccggtgctcgatttagtagtgtagatttgggtttgggggaaggaggaagactgacggtcctgccacagcggccctgggctcgcctggtcaaggactacttccagtactctatctgagcgggctggcaaggcgcatagnnnnnnnnnnnnnnnnnnnnnnnnnnnnnn

SEQ ID NO: 213746 - DNA, 155 bp, Homo sapiens
  misc_feature: GYAE6OF01DLQST.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagactgacggtcctgccacaggggccctgggctgcctggtcaaggactacttccctacagtgctctgagcgggctggcaaggcgcatagn

SEQ ID NO: 213747 - DNA, 155 bp, Homo sapiens; identical to SEQ ID NO: 213729
  misc_feature: GYAE6OF01AHTUX.1.25.C03.1.454.CMB.1.raw
  modified_base (155)..(155): a, c, t, g, unknown or other
  misc_feature (155)..(155): n is a, c, g, or t

SEQ ID NO: 213748 - DNA, 154 bp, Homo sapiens
  misc_feature: GYAE6OF01DV25Z.1.25.C03.1.454.CMB.1.raw
tcagacgagtgcgtcacgaccggtgctcgatttagtagtgtagatttgggtttgggggaagaggaagactgacggtcctgccacagcggccctgggctgcctggtcaaggactacttccgagtgcgtctctgagcgggctggcaaggcgcatag

SEQ ID NO: 213749 - DNA, 155 bp, Homo sapiens
  misc_feature: GYAE6OF01BI0YM.1.25.C03.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtagtgtagatttgggtttggggaagaggaagactgacggtcctgccacagcggccctgggctgcctggtcaaggactacttccagtactctatctgagcgggctggcaaggcgcatagnn

SEQ ID NO: 213750 - DNA, 156 bp, Homo sapiens
  misc_feature: GYAE6OF01EK2OQ.1.25.C03.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtagtgtagatttgggtttgggggaagaggaagactgacggtcctgccacagcggccctgggctgcctggtcaaggactacttccagtactctatctgagcgggctggcaaggcgcatagnn

SEQ ID NO: 213751 - DNA, 155 bp, Homo sapiens
  misc_feature: GYAE6OF01BRPTL.1.25.C03.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtagtgtagatttgggtttgggggaagaggaagactgacggtcctgccacagcggccctgggctgcctggtcaaggctacttccagtactctatctgagcgggctggcaaggcgcatagnn

SEQ ID NO: 213752 - DNA, 605 bp, Homo sapiens
  misc_feature: GYAE6OF01DDGLY.1.25.C03.1.454.CMB.1.raw
  modified_base (443)..(443): a, c, t, g, unknown or other
  misc_feature (443)..(443): n is a, c, g, or t
  modified_base (563)..(563): a, c, t, g, unknown or other
  misc_feature (563)..(563): n is a, c, g, or t
  modified_base (592)..(592): a, c, t, g, unknown or other
  misc_feature (592)..(592): n is a, c, g, or t
tcagacgagtgcgtcacgaccggtgctcgatttagtagtgtagatttgggtttgggggtcagacccagtcaggacacagcatggacatgagggtccccgctcagctcctggggctcctgctgctctggttcccaggttccagatgcgacatccagattacccagtctccatcttccgtgtctgcatctgtcggagacagagtcaccatcacttgtcgggcagtcagggtattagcagctggttagcctggtatcagcaagaaaccagggaaacgcccccaaatcctgatctatgctgcatccgtagtttagaaaaggttcggggtccctaagtaccgtaaagggttcacggcggacgagggtcggagttcgtagggaactaggtactttccacttcctaccaacctatacagccacggcctgacacgtcctaggtaaacgttnttttacgacgttaaagtttacttattcgtaccaaacgacggtaccctaaacgttccgtttaccctacggtaaccgttcgaccgtaaacgggaccaaaggtaaccgaaaccaaacggtacnggtacgctacggcacctatcgtatcttanctccgtcccgtac

SEQ ID NO: 213753 - DNA, 206 bp, Homo sapiens
  misc_feature: GYAE6OF01CMNQE.1.25.C03.1.454.CMB.1.raw
  modified_base (61)..(61): a, c, t, g, unknown or other
  misc_feature (61)..(61): n is a, c, g, or t
  modified_base (153)..(153): a, c, t, g, unknown or other
  misc_feature (153)..(153): n is a, c, g, or t
  modified_base (157)..(206): a, c, t, g, unknown or other
  misc_feature (157)..(206): n is a, c, g, or t
tcagacgagtgcgtcacgaccggtgctcgatttagtagtgtagatttgggttggggggaanaggaacgactgacggtcctgccacagcggccctgggctgccctggtcaaggctacttccgatactctatctgagcgggctcggcgaaggcgnatgnnnnnnnnnnnnnnnnnnnnnnnnnnnnnnnnnnnnnnnnnnnnnnnnnn

SEQ ID NO: 213754 - DNA, 156 bp, Homo sapiens; identical to SEQ ID NO: 213750
  misc_feature: GYAE6OF01BLJWK.1.25.C03.1.454.CMB.1.raw
  modified_base (155)..(156): a, c, t, g, unknown or other
  misc_feature (155)..(156): n is a, c, g, or t

SEQ ID NO: 213755 - DNA, 155 bp, Homo sapiens
  misc_feature: GYAE6OF01BI4ST.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagactgacggtcctgccacagcggccctgggctgcctggtcaaggactacttccgagtgcgtctctgagcgggctggcaaggcgcatagn

SEQ ID NO: 213756 - DNA, 164 bp, Homo sapiens
  misc_feature: GYAE6OF01BAJUL.1.25.C03.1.454.CMB.1.raw
  modified_base (156)..(164): a, c, t, g, unknown or other
  misc_feature (156)..(164): n is a, c, g, or t
tcagacgagtgcgtcacgaccggtgctcgatttagtagtgtagatttgggtttgggggaagaggaagactgacggtcctgccacgagcggccctgggctgcctggtcaaggactacttccagtactctatcctgagcggctggcaaggcgcatagnnnnnnnnn

SEQ ID NO: 213757 - DNA, 536 bp, Homo sapiens
  misc_feature: GYAE6OF01DSYJG.1.25.C03.1.454.CMB.1.raw
  modified_base (277)..(277): a, c, t, g, unknown or other
  misc_feature (277)..(277): n is a, c, g, or t
tcagacgagtgcgtcacgaccggtgctcgatttagtagtgtagattgggtttgggggtcagacccagtcaggacacagcatggacatgagggtccccgctcagctcctggggctcctgctgctctggttcccaggttccagatgcgacatccagatgacccagtctccatcttccgtgtctgcatctgtcggagacagagtcaaccatcacttgtcgggcagtcaggccatcagcgattctttagcctggttgcagcagaaaccagggcagcccctnagatcgtagtctatggtgcatccagattgacaaggtcgggtccatccaggttcagtgcagtgcatcgtggacagtacttacactctctaacgtatcagcaacgcctgctagcctagaacgttattttggacttaagttttattaacgtgttacaaacgtagtttaacttagttacgtaccccgttagtacggtacgttccggacggtacgggacctaagggtcgaacgtacgaacgaacttggacggtctgccgctacg

SEQ ID NO: 213758 - DNA, 161 bp, Homo sapiens
  misc_feature: GYAE6OF01ANR66.1.25.C03.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtagtgtagatttgggtttgggggaagaggaagactgacggtcctgccacagcggccctgggctgcctggtcaaggactacttccagtactctatctgagcgggctggcaaggcgcatagnnnnnnn

SEQ ID NO: 213759 - DNA, 602 bp, Homo sapiens
  misc_feature: GYAE6OF01EIXBN.1.25.C03.1.454.CMB.1.raw
tcagacgagtgcgtcacgaccggtgctcgatttagtagtgtagatttgggtttgggggtcagacccagtcaggacacagcatggacatgagggtccccgctcagctcctggggctcctgctgctctggttcccaggttccagatgcgacatccagatcgacccagtctccatcttccgtgtctgcatctgtcggagacagagtcaccatcacttgtcgggcgagtcagggtatagcagctggttagcctggtatcagcagaaaccgaggaaacgcccccaaactcctgatctatgctgcatcctagtttagaaagtcgggtacccatcgaaggttcagcggcaggtggatcgtagggacagtactttcactctacaccatcagcagcctgcacgccgtagaagttattttcgacttaagtttactagtttcgtacaaccgacggtacctaacgtaccgtttaccccgtacggttaaccggttccggaccgaaacgggtaaccgaaacgggtaaccggaaaaccgaaaaccggtacgttacggtacgggtacctacgacccaactattccgttacgttaccttacctacttcccgttaccccg

SEQ ID NO: 213760 - DNA, 661 bp, Homo sapiens
  misc_feature: GYAE6OF01DHQTE.1.25.C03.1.454.CMB.1.raw
  modified_base (416)..(416): a, c, t, g, unknown or other
  misc_feature (416)..(416): n is a, c, g, or t
tcagacgagtgcgtcacgaccggtgctcgatttagtagtgtagatttgggtttggggggacatgagggtccccgctcagctcctggggctcctgctgctctggctcccaggtaccagctgtgacatccaattgacccagtctccatcctccctgtctgcatctattggagacagagtccaccatcacgttcggccgggcgagtcgaggccatcagcgtatttcttagccgttggtgacagacaaggaaaccgaggggcgacgcccctagagacttacgtagttctagtggtgcactaccagtagttcgacggtaacgggtcgggtaccctagtccgtaggttcgaggtggcagtgcagtcgtaggactagtactacactctcactatcagcacgcctgctacgacgtagtaagttnttttacgaactttaagttttactacgttacgtaactaacgtagtttaacgttaacttaacccgttaacccgttagggttaccgggtaaccggttccggtaaccgggacgggtaaccgggtaagggtacggaacgtttaaccgaaccggttagtacgggtcgaccgttacgacctaccgttagttcccttgttacccttactacccgtttcccgtaccccgtacgtacttccgacggttaaccccg

SEQ ID NO: 213761 - DNA, 155 bp, Homo sapiens
  misc_feature: GYAE6OF01D61L1.1.25.C03.1.454.CMB.1.raw
tcagacgagtgcgtcacgaccggtgctcgatttagtagtgtagatttgggtttggggggaagaggaagactgacggtcctgccacagcggccctgggctgcctggtcaaggactacttccagtactctatctgagcgggctggcaaggcgcatag

SEQ ID NO: 213762 - DNA, 198 bp, Homo sapiens
  misc_feature: GYAE6OF01A7NWQ.1.25.C03.1.454.CMB.1.raw
  modified_base (160)..(198): a, c, t, g, unknown or other
  misc_feature (160)..(198): n is a, c, g, or t
tcagacgagtgcgtcacgaccggtgctcgatttagtagtgtagatttgggtttgggggggaagaggaagactgacggtcctgccacagcggccctgggcctgcctggtcaaggactacttccagtactctatctgagccgggctggcaaggcgcatagtnnnnnnnnnnnnnnnnnnnnnnnnnnnnnnnnnnnnnnn

SEQ ID NO: 213763 - DNA, 608 bp, Homo sapiens
  misc_feature: GYAE6OF01EJBJR.1.25.C03.1.454.CMB.1.raw
  modified_base (434)..(434): a, c, t, g, unknown or other
  misc_feature (434)..(434): n is a, c, g, or t
tcagacgagtgcgtcacgaccggtgctcgatttagtagtgtagatttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtcggagacagagtcaccatcacttgtcgggcgagtcgagggtattagcagctggttagccgtggtatcagacaagaaaccgagggaaaccgaccccaaactcctagactctatgctgctatccagtttagaaaggtcgggtaccatacgtagtcagcggctaggtgagtcgtaggactagtattacacttctacgacctagtacagtccgacgtcctagacacgtccgtagtaacgttntttagactttaagtactagttacgtactaacgacggtaacctaacttaccgtttacccacggtaaccggtaccggaaccggtaacgggaaaccgtaaacgggtaacgtaaaacccgtaaacgtacgttcggtacggtacgttacgacctacctagttccttcgttccttacccg

SEQ ID NO: 213764 - DNA, 581 bp, Homo sapiens
  misc_feature: GYAE6OF01CF5U2.1.25.C03.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
  modified_base (545)..(545): a, c, t, g, unknown or other
  misc_feature (545)..(545): n is a, c, g, or t
  modified_base (548)..(581): a, c, t, g, unknown or other
  misc_feature (548)..(581): n is a, c, g, or t
tcagacgagtgcgtcacgaccggtgctcgatttagtagtgtagatttgggtttgggggagacagagtcaccatcacttgtcgggcgagtcagggtattagcagctggttagcctggtatcagcagaaaccagggaaacgcccccaaactcctgatctatgctgcatccagtttagaaaagtgggtcccatcaaggtcagcgnagtggatctgggacagatttcactctcaccatcagcagcctgcagcctagaagtnttttgactaatttattactgtacaactagtattataacgttaccccctagtcggtaacgttccggaccgtaaggggaaccctaagggtacggaaacgttaccgaaacccggtaacgttgggtcggaccgttagaccctaacccgtaagttccgttacgtccttttacccacgtttcccgtttacccccgacctacttacccgttacgaaaaccggtcccttaacccgtcccggttacgtacgggacgggcccgggtacgtcgggaccgaaagggccgataacgtaggnatnnnnnnnnnnnnnnnnnnnnnnnnnnnnnnnnnn

SEQ ID NO: 213765 - DNA, 503 bp, Homo sapiens
  misc_feature: GYAE6OF01CK3FS.1.25.C03.1.454.CMB.1.raw
  modified_base (478)..(503): a, c, t, g, unknown or other
  misc_feature (478)..(503): n is a, c, g, or t
tcagacgagtgcgtcacgaccggtgctcgatttagtagtgtagatttgggtttgggggagacagagtcaccatcacttgtcgggcgagtcagggtattagcagctggttagcctggtatcagcagaaaccagggaaagcccccaaactcctgatctatgctgcatccagtttgaaaagtggggtcccatcaaggttcagcggcagtggatcgtgggacagattacactctcactatcagcagcctgcagcctgaagtattttgactaatttattactgtacaactagtattatacgtacccctagtcggtacgttcggccgagggacctaaggtaggaacgtccgaaaccgactggtcgctcgacacctatctcgttctctacttcccttccccgtccccttcctccaccgtacctaccgttcgtacgtcggacggtccgggacgttcgggaccgtaaacgggccgtactagtagctnnnnnnnnnnnnnnnnnnnnnnnnnn

SEQ ID NO: 213766 - DNA, 542 bp, Homo sapiens
  misc_feature: GYAE6OF01AP4QV.1.25.C03.1.454.CMB.1.raw
  modified_base (521)..(542): a, c, t, g, unknown or other
  misc_feature (521)..(542): n is a, c, g, or t
tcagacgagtgcgtcacgaccggtgctcgatttagtagtgtagatttggggtttggggggagacagagtcaccatcacttgtcgggcgagtcagggtattagcagctggttagcctggtatcagcagaaaccagggaaacgccccccaaactcctgatctatgctgcatcctagtttagaaagtcgggtcccatcgaaggttcagcggcagtggatcgtgggacagtactttcactcctacaccatcacgcacgcctgcacgtccgtagtaagttattttgactaagtttactattcgtacaaacgacggtacctaacgtcgtttaccccgtacggtaaccggttccggaaccgaaacgggaccgtaaacgggtaaccgaaaaacccgtaaaggaccgtggtacggactacgaccacctatccttcgtaccttctaccttcccgtccccactactccgtaccgaacgtccctacgttcgtacgtcggacggtccgggcgtacggacgacgcgacagtacgnnnnnnnnnnnnnnnnnnnnnn

SEQ ID NO: 213767 - DNA, 158 bp, Homo sapiens
  misc_feature: GYAE6OF01AQZY4.1.25.C03.1.454.CMB.1.raw
  modified_base (156)..(158): a, c, t, g, unknown or other
  misc_feature (156)..(158): n is a, c, g, or t
tcagacgagtgcgtcacgaccggtgctcgatttagtagtgtagatttgggtttggggggaagaggaagactgacggtcctgccacagcggccctgggctgcctggtcaaggactacttccctacagtgctctgagcgggctggcaaggcgcatagnnn

SEQ ID NO: 213768 - DNA, 810 bp, Homo sapiens
  misc_feature: GYAE6OF01BW3OJ.1.25.C03.1.454.CMB.1.raw
  modified_base (266)..(266): a, c, t, g, unknown or other
  misc_feature (266)..(266): n is a, c, g, or t
tcagacgagtgcgtcacgaccggtgctcgatttagtagtgtagatttgggtttgggggagtcagacccagtcaggacacagcatggacatgagggtccccgctcagctccgtggggctcctgctgctctggttcccaggttccagatgcgacatccagatcgacccagtcctccatcttccgtgtctgcatctgtcggagacagagtccacatcctacttggcggcgtagtcgagggttatagcgagtcgtggttagccgtggtancgagactaacggaaaccgaacgggaaaccgaccccctaaactccgtagacttctagtcgctcacacttacgtagtttaacggtaaacggtcgggtaccctaagttacgtaacggttacacggtcggtactacggtagtacgtacggtaggtaacgtacggtttacctttacacccttaccgtaccaactaaccgtaccgaacggtcccaacggttcccgtagaccgtaaccgtaccgtttaaggttaaaccttttaggttttacgaacgtttaaacggtttaaccttaggtttacctaaccgaaacgtaacccggtaaccttaaccggttcccgttttaaccccggttaccggttaaacccgggttacccgggaaacccggtaaacggggtaaacccgggtaaaacgggtttaaacccggaaaaaaccccggtaaacggtaacgggttacgggtaacccggttacgtaaaccccggacccgttaaacccgttaccgttacccggtttaactttcccgtttaccctaccccggttttaccccccc

SEQ ID NO: 213769 - DNA, 176 bp, Homo sapiens
  misc_feature: GYAE6OF01BBXVY.1.25.C03.1.454.CMB.1.raw
  modified_base (155)..(176): a, c, t, g, unknown or other
  misc_feature (155)..(176): n is a, c, g, or t
tcagacgagtgcgtcacgaccggtgctcgatttagtagtgtagatttgggtttggggggaagaggaagactgacggtcctgccacagtggccctgggctgcctggtcaaggactacttccagtactctatctgagcggctggcaaggcgcatagnnnnnnnnnnnnnnnnnnnnnn

SEQ ID NO: 213770 - DNA, 750 bp, Homo sapiens
  misc_feature: GYAE6OF01AJ5FY.1.25.C03.1.454.CMB.1.raw
  modified_base (60)..(60): a, c, t, g, unknown or other
  misc_feature (60)..(60): n is a, c, g, or t
  modified_base (617)..(617): a, c, t, g, unknown or other
  misc_feature (617)..(617): n is a, c, g, or t
  modified_base (650)..(650): a, c, t, g, unknown or other
  misc_feature (650)..(650): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (668)..(668): a, c, t, g, unknown or other
  misc_feature (668)..(668): n is a, c, g, or t
  modified_base (674)..(674): a, c, t, g, unknown or other
  misc_feature (674)..(674): n is a, c, g, or t
tcagacgagtgcgtcacgaccggtgctcgatttagtagtgtagatttgggtttggggganacagagtcaccatcacttgtcgggcgagtcagggtattagcagctggttagcctggtatcagcaacgaaaccgacgggaaacaccccaaactcctgtatctatcgctgctaactctaggttagtaaacggtcgggtacccagtacgtaagttcgacggcggactagtggtacgttcgtaggggacaggttacttacaccttacctcaacctactacgacgaccgtacgcctcggtaccgagtccgtagtaacgtttgtttaccgtaacgtaacgttattagttacgaacgtaacggaccgtactaccttaccgttacctacggttaacccggtcggaaccggtaacgggaaccgtaaggaaaaccgaaaccgaaagtacggttacgggtcgtaacgtccgaaccgaccttaacttccggtacttccctaccctaccggtttaccccctacctcccctacgtacccgtaccgtaccgttaccgtctttacccgggtagtaccgggtccggaccgtaccgtaaccggggttacccaacgggttcctaagccggggttanccgtacggtacgagactctacgcgtcgacgctnacgtgngacnctacgtcncgtacngtactacgactccgtcgtacgcacgtaccgaccgacggaaaaaaaaaaaaaaaaaaaaaaacgacgcgtcgtggtc

SEQ ID NO: 213771 - DNA, 528 bp, Homo sapiens
  misc_feature: GYAE6OF01EQS4W.1.25.C03.1.454.CMB.1.raw
  modified_base (486)..(528): a, c, t, g, unknown or other
  misc_feature (486)..(528): n is a, c, g, or t
tcagacgagtgcgtcacgaccggtgctcgatttagtagtgtagatttggggtttgggggggagacagagtcaccatcacttgtcgggcgagtcagggtattagcagctggttagcctggtatcagcagaaaccagggaaagcccccaaaatcctgatctatgctgcatccagtttagaaaaggtggggtcccatactaaggttcaggcggcgaggtggatcgtggggaactagtattttaccacttcctacaacctaatccaagccaagccctaggcaacgtccgtagaaggtattttgactaagttactattgtacaacacggaccaactacgtttccctacggtaaccgttacgggaccgaaacggggaaccgaaagggtacggaaaaacctaaaacgaacctaggtacggcgtcggaccacctaactccgttagtccttactacgttccctttaccccgacctacgtacgtacgaaacccgannnnnnnnnnnnnnnnnnnnnnnnnnnnnnnnnnnnnnnnnnn

SEQ ID NO: 213772 - DNA, 172 bp, Homo sapiens
  misc_feature: GYAE6OF02GAZAR.1.25.C03.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtagtgtagattgggttgggaagaggaagactgacggtcctgctccaggagcacctccgagagcacagcggccctgggctgcctggtcaaggactacttccacgcactcgtctgagcgggctggcaaggcgcatagnn

SEQ ID NO: 213773 - DNA, 160 bp, Homo sapiens
  misc_feature: GYAE6OF02IZB3Y.1.25.C03.1.454.CMB.1.raw
  modified_base (151)..(160): a, c, t, g, unknown or other
  misc_feature (151)..(160): n is a, c, g, or t
tcagacgagtgcgtcacgaccggtgctcgatttagtagtgtagatttggttgggaagaggaagactgacggtcctgccacagcggccctgggcctgcctggtcaaggactacttccagtactctatctgagcggctggcaaggcgcatagnnnnnnnnnn

SEQ ID NO: 213774 - DNA, 157 bp, Homo sapiens
  misc_feature: GYAE6OF02GUWW1.1.25.C03.1.454.CMB.1.raw
  modified_base (155)..(157): a, c, t, g, unknown or other
  misc_feature (155)..(157): n is a, c, g, or t
tcagacgagtgcgtcacgaccggtgctcgatttagtagtgtagatttgggtttgggggaagaggaagactgacggtcctgccacagcggccctgggctgcctggtcaaggactacttccctacagtgctctgagcgggctggcaaggcgcatagnnn

SEQ ID NO: 213775 - DNA, 155 bp, Homo sapiens; identical to SEQ ID NO: 213729
  misc_feature: GYAE6OF02IWBMK.1.25.C03.1.454.CMB.1.raw
  modified_base (155)..(155): a, c, t, g, unknown or other
  misc_feature (155)..(155): n is a, c, g, or t

SEQ ID NO: 213776 - DNA, 156 bp, Homo sapiens; identical to SEQ ID NO: 213750
  misc_feature: GYAE6OF02G0LYL.1.25.C03.1.454.CMB.1.raw
  modified_base (155)..(156): a, c, t, g, unknown or other
  misc_feature (155)..(156): n is a, c, g, or t

SEQ ID NO: 213777 - DNA, 164 bp, Homo sapiens
  misc_feature: GYAE6OF02GL55Q.1.25.C03.1.454.CMB.1.raw
  modified_base (155)..(164): a, c, t, g, unknown or other
  misc_feature (155)..(164): n is a, c, g, or t
tcagacgagtgcgtcacgaccggtgctcgatttagtagtgtagatttgggtttgggggaagaggaagactgacggtcctgccacagcggccctgggctgcctggtcaaggactacttccacgcactcgtctgagcgggctggcaaggcgcatagnnnnnnnnnn

SEQ ID NO: 213778 - DNA, 175 bp, Homo sapiens
  misc_feature: GYAE6OF02F1D5J.1.25.C03.1.454.CMB.1.raw
  modified_base (174)..(175): a, c, t, g, unknown or other
  misc_feature (174)..(175): n is a, c, g, or t
tcagacgagtgcgtcacgaccggtgctcgatttagtagtgtagatttgggtttggggaagaggaagactgacggtcctgctccaggagcacctccgagagcacagcggccctgggctgcctggtcaaggactacttccacgcactcgtctgagcgggctggcaaggcgcatagnn

SEQ ID NO: 213779 - DNA, 155 bp, Homo sapiens
  misc_feature: GYAE6OF02IW0EI.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagactgacggtactgccacagcggccctgggctgcctggtcaaggactacttccacgcactcgtctgagcgggctggcaaggcgcatagn

SEQ ID NO: 213780 - DNA, 155 bp, Homo sapiens
  misc_feature: GYAE6OF02H2B0K.1.25.C03.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtagtgtagatttgggtttgggggaagaggaagactgacggtcctgccacagcggccctgggctgcctggtcaaggactattccagtactctatctgagcgggctggcaaggcgcatagnn

SEQ ID NO: 213781 - DNA, 155 bp, Homo sapiens; identical to SEQ ID NO: 213729
  misc_feature: GYAE6OF02G5TMN.1.25.C03.1.454.CMB.1.raw
  modified_base (155)..(155): a, c, t, g, unknown or other
  misc_feature (155)..(155): n is a, c, g, or t

SEQ ID NO: 213782 - DNA, 158 bp, Homo sapiens
  misc_feature: GYAE6OF02F7BIE.1.25.C03.1.454.CMB.1.raw
  modified_base (155)..(158): a, c, t, g, unknown or other
  misc_feature (155)..(158): n is a, c, g, or t
tcagacgagtgcgtcacgaccggtgctcgatttagtagtgtagatttgggtttgggggaagaggaagactgacggtcctgccacagcggccctgggctgcctggtcaaggactacttccctacagtgctctgagcgggctggcaaggcgcatagnnnn

SEQ ID NO: 213783 - DNA, 163 bp, Homo sapiens
  misc_feature: GYAE6OF02HTDP6.1.25.C03.1.454.CMB.1.raw
  modified_base (163)..(163): a, c, t, g, unknown or other
  misc_feature (163)..(163): n is a, c, g, or t
tcagacgagtgcgtcacgaccggtgctcgatttagtagtgtagatttgggtttgggaagtagtccctgctccaggagcacctccgagagcacagcggccctgggctgcctggtcaaggactacttccacgcactcgtctgagcgggctggcaaggcgcatagn

SEQ ID NO: 213784 - DNA, 155 bp, Homo sapiens
  misc_feature: GYAE6OF02FGZIV.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagactgacggtcgtgccacagcggccctgggctgcctggtcaaggactacttccgagtgcgtctctgagcgggctggcaaggcgcatagn

SEQ ID NO: 213785 - DNA, 156 bp, Homo sapiens; identical to SEQ ID NO: 213750
  misc_feature: GYAE6OF02GHLFJ.1.25.C03.1.454.CMB.1.raw
  modified_base (155)..(156): a, c, t, g, unknown or other
  misc_feature (155)..(156): n is a, c, g, or t

SEQ ID NO: 213786 - DNA, 418 bp, Homo sapiens
  misc_feature: GYAE6OF02I6IYQ.1.25.C03.1.454.CMB.1.raw
  modified_base (409)..(418): a, c, t, g, unknown or other
  misc_feature (409)..(418): n is a, c, g, or t
tcagacgagtgcgtcacgaccggtgctcgatttagtagtgtagatttgggtttgggggagacagagtcaccatcacttgtcgggcgagtcagggtattagcagctggttagcctggtatcagcagaaaccagggaaagcccccaaactcctgatctatgctgcatacagtttgaaaagtgggtcccatcaaggttcagcggcagtggatctgggacagatttcactctcaccatcagcagcctgcagcctgagattttgcaagttactattgtcaacaggccaacagtttccctcgaacgttcggccaaggggaccaaggtggaagtcaaccgaactgtggctgcacatctgtcttcatcttcccgcatctgaacgcactcgtctgagcgggctggcaaggcgcatagnnnnnnnnnn

SEQ ID NO: 213787 - DNA, 156 bp, Homo sapiens
  misc_feature: GYAE6OF02IQSDQ.1.25.C03.1.454.CMB.1.raw
  modified_base (156)..(156): a, c, t, g, unknown or other
  misc_feature (156)..(156): n is a, c, g, or t
tcagacgagtgcgtcacgaccggtgctcgatttagtagtgtagatttgggtttggggggaagaggaagactgacggtcctgccacagcggccctgggctgcctggtcaaggactacttccagtactctatctgagcgggctggcaaggcgcatagn

SEQ ID NO: 213788 - DNA, 155 bp, Homo sapiens; identical to SEQ ID NO: 213755
  misc_feature: GYAE6OF02IRLY5.1.25.C03.1.454.CMB.1.raw
  modified_base (155)..(155): a, c, t, g, unknown or other
  misc_feature (155)..(155): n is a, c, g, or t

SEQ ID NO: 213789 - DNA, 428 bp, Homo sapiens
  misc_feature: GYAE6OF02H33UV.1.25.C03.1.454.CMB.1.raw
  modified_base (417)..(428): a, c, t, g, unknown or other
  misc_feature (417)..(428): n is a, c, g, or t
tcagacgagtgcgtcacgaccggtgctcgatttagtagtgtagatttgggtttgggggagacagagtcaccatcacttgtcgggcgagtcagggtattagcagctggttagcctggtatcagcagaaaccagggaaagcccccaaaactccctgatctatgctgcatccagtttgaaaagtggggtcccatcaaggttcagcggcagtggatctgggacagatttcactctcaccatcagcagcctgcagcctgaagattttgcaagttactattgtcaacaggccaaacagtttcccctgaaccgtttcggaccaagggaccaaaggtggaaaaccaaacgaactgtggactgcaccatctgtctcatcttccgcatactgaacgcactcgtctgagcggctggcaagcgcatagnnnnnnnnnnnn

SEQ ID NO: 213790 - DNA, 162 bp, Homo sapiens
  misc_feature: GYAE6OF02FV8PN.1.25.C03.1.454.CMB.1.raw
  modified_base (155)..(162): a, c, t, g, unknown or other
  misc_feature (155)..(162): n is a, c, g, or t
tcagacgagtgcgtcacgaccggtgctcgatttagtagtgtagatttgggtttgggggaagaggaagactgacggtcctgccacagcggccctgggctgcctggtcaaggactacttccagtactctatctgagcgggctggcaaggcgcatagnnnnnnnn

SEQ ID NO: 213791 - DNA, 155 bp, Homo sapiens
  misc_feature: GYAE6OF02HPD3H.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagaatgacggtcctgccacagcggccctgggctgcctggtcaaggactacttccacgcactcgtctgagcgggctggcaaggcgcatagn

SEQ ID NO: 213792 - DNA, 155 bp, Homo sapiens; identical to SEQ ID NO: 213740
  misc_feature: GYAE6OF02HDXD3.1.25.C03.1.454.CMB.1.raw
  modified_base (155)..(155): a, c, t, g, unknown or other
  misc_feature (155)..(155): n is a, c, g, or t

SEQ ID NO: 213793 - DNA, 155 bp, Homo sapiens
  misc_feature: GYAE6OF02GEQJ9.1.25.C03.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtagtgtagatttgggtttgggggaagaggaagactgacggtcctgccacagcggccctgggctgcctggtcaaggactacttccctacagtgctctgagcgggctggcaaggcgcatagn

SEQ ID NO: 213794 - DNA, 426 bp, Homo sapiens
  misc_feature: GYAE6OF02HHU7C.1.25.C03.1.454.CMB.1.raw
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (413)..(426): a, c, t, g, unknown or other
  misc_feature (413)..(426): n is a, c, g, or t
tcagacgagtgcgtcacgaccggtgctcgatttagtagtgtagatttgggtttgggggagacagagtcaccatcacttgtcgggcgagtcagggtattagcagctggttagcctggtatcagcagaaaccagggaaagcccccaaactcctgatctatgctgcatccagtttgaaagtgggtcccatcaaggttcagcggcagtggatctgggacagatttcactctcaccatcagcagcctgcagcctgaagattttgcaagttactattgtcaacaggccaaacagtttcccctcgaacgttcggccaagggaccaaggtggaaaccaaacgaactgtggctgcaccatctgtcttcatcttccgccatctgacncactcgtctgagcgggctggcaaggcncatagnagnnnnnnnnnnnnnn

SEQ ID NO: 213795 - DNA, 193 bp, Homo sapiens
  misc_feature: GYAE6OF02IL6SJ.1.25.C03.1.454.CMB.1.raw
  modified_base (143)..(143): a, c, t, g, unknown or other
  misc_feature (143)..(143): n is a, c, g, or t
  modified_base (161)..(162): a, c, t, g, unknown or other
  misc_feature (161)..(162): n is a, c, g, or t
  modified_base (164)..(166): a, c, t, g, unknown or other
  misc_feature (164)..(166): n is a, c, g, or t
  modified_base (168)..(193): a, c, t, g, unknown or other
  misc_feature (168)..(193): n is a, c, g, or t
tcagacgagtgcgtcacgaccggtgctcgatttagtagtgtagattggtttgggggtaaggaggagacgtgacggtcctggcacagcggccctgggctgcctcggtcaaggcctacttccctacagttgcctctgagccggcnggacaaggcgcctaatgnncnnnannnnnnnnnnnnnnnnnnnnnnnnnn

SEQ ID NO: 213796 - DNA, 199 bp, Homo sapiens
  misc_feature: GYAE6OF02FO0JM.1.25.C03.1.454.CMB.1.raw
  modified_base (157)..(199): a, c, t, g, unknown or other
  misc_feature (157)..(199): n is a, c, g, or t
tcagacgagtgcgtcacgaccggtgctcgatttagtagtgtagatttgggtttgggggaagagggaagacgtgacggtcctgccacagcggcctgggctgcctggtcaaggctattccagtactctatctgtagcgggctgggcaaggcgtcatagnnnnnnnnnnnnnnnnnnnnnnnnnnnnnnnnnnnnnnnnnnn

SEQ ID NO: 213797 - DNA, 370 bp, Homo sapiens
  misc_feature: GYAE6OF02G3BJI.1.25.C03.1.454.CMB.1.raw
  modified_base (362)..(370): a, c, t, g, unknown or other
  misc_feature (362)..(370): n is a, c, g, or t
tcagacgagtgcgtcacgaccggtgctcgatttagtagtgtagatttgggtttgggggctttccctggtatcagcagaaaccagggaaagcccccaaactcctgatctatgctgcatccagtttgaaaagtggggtcccatcaaggttcagcggcagtggatctgggacagatttcactctcaccatcagcagcctgcagcctgaagattttgcaagttactattgtcaacaggccaacagtttccctcgaacgttcggccaaggggaccaaggtggaaaccaaacgaactgtggctgcacatctgtcttcatctccgccatctgaacgcactcgtctgagcggctggcaaggcgcatagcnnnnnnnnn

SEQ ID NO: 213798 - DNA, 156 bp, Homo sapiens
  misc_feature: GYAE6OF02JA793.1.25.C03.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtagtgtagatttgggtttgggggaagaggaagactgacggtcctgccacagcggccctgggctgcctggtcaaggactacttccgagtgcgtctctgagcgggctggcaaggcgcatagnn

SEQ ID NO: 213799 - DNA, 154 bp, Homo sapiens
  misc_feature: GYAE6OF02ICRNQ.1.25.C03.1.454.CMB.1.raw
tcagacgagtgcgtcacgaccggtgctcgatttagtagtgtagatttgggtttggggggagaggaagactgacggtcctgccacagcggccctgggctgcctggtcaaggactacttccagtactctatctgagcgggctggcaaggcgcatag

SEQ ID NO: 213800 - DNA, 158 bp, Homo sapiens
  misc_feature: GYAE6OF02IZ36X.1.25.C03.1.454.CMB.1.raw
  modified_base (156)..(158): a, c, t, g, unknown or other
  misc_feature (156)..(158): n is a, c, g, or t
tcagacgagtgcgtcacgaccggtgctcgatttagtagtgtagatttgggtttggggggaagaggaagactgacggtcctgccacagcggccctgggctgcctggtcaaggactacttccagtactctatctgagcgggctggcaaggcgcatagnnn

SEQ ID NO: 213801 - DNA, 156 bp, Homo sapiens; identical to SEQ ID NO: 213739
  misc_feature: GYAE6OF02HP6QE.1.25.C03.1.454.CMB.1.raw
  modified_base (155)..(156): a, c, t, g, unknown or other
  misc_feature (155)..(156): n is a, c, g, or t

SEQ ID NO: 213802 - DNA, 168 bp, Homo sapiens
  misc_feature: GYAE6OF02F4YU4.1.25.C03.1.454.CMB.1.raw
  modified_base (156)..(168): a, c, t, g, unknown or other
  misc_feature (156)..(168): n is a, c, g, or t
tcagacgagtgcgtcacgaccggtgctcgatttagtagtgtagatttgggtttgggggaagaggaagactgacggtcctgccacagcggccctgggcctgcctggtcaaggactacttccgagtgcgtctctgagcgggctggcaaggcgcatagnnnnnnnnnnnnn

SEQ ID NO: 213803 - DNA, 558 bp, Homo sapiens
  misc_feature: GYAE6OF02GIZJJ.1.25.C03.1.454.CMB.1.raw
  modified_base (365)..(365): a, c, t, g, unknown or other
  misc_feature (365)..(365): n is a, c, g, or t
tcagacgagtgcgtcacgaccggtgctcgatttagtagtgtagatttgggtttgggggacatgagggtccccgctcagctcctggggctcctgctgctctggttcccaggttccagatgcgacatccagatgacccagtctccatcttccgtgtctgcatctgtcggagacagagtcaccatcacttgtcgggcgagtcagggtattagcagctggttagcctggtatcagcagaaaccagggaaacgccccaaactcctgatctatgctgcatccagtttgaaaagtgggtcccatcaaggttcagcgcagtggatcgtgggacagatttcactctcaccatcagcagcctgcagcctgaagtnttttagctaagttactattgtacaaacacggacccaacgtacgttttccctacgtaaccgttccggaccgaaacgggacccgtaaagggtacggaaaacctaaacgaacgtagtacggactacgacaccgatcgtagtcttcacgttccttacccgctatctagaaccgtctacctcgtctaggaggtccggg

SEQ ID NO: 213804 - DNA, 370 bp, Homo sapiens
  misc_feature: GYAE6OF02GNRJ5.1.25.C03.1.454.CMB.1.raw
  modified_base (359)..(359): a, c, t, g, unknown or other
  misc_feature (359)..(359): n is a, c, g, or t
  modified_base (365)..(370): a, c, t, g, unknown or other
  misc_feature (365)..(370): n is a, c, g, or t
tcagacgagtgcgtcacgaccggtgctcgatttagtagtgtagatttgggtttgggggctttccctggtatcagcagaaaccagggaaagcccccaaactcctgatctatgctgcatccagtttgaaaagtggggtcccatcaaggttcagcggcagtggatctgggacagatttcactctcaccatcagcagcctgcagcctgaagattttgcaagttactattgtcaacaggccaacagtttccctcgaacgttcggccaagggaccaaggtcggaaaccaaccgaactgtggctgcaccatctgtcttcatcttcccgcatctgaacgcactcgtctgagcgggctggcaagggcncatagnnnnnn

SEQ ID NO: 213805 - DNA, 605 bp, Homo sapiens
  misc_feature: GYAE6OF02I2QHJ.1.25.C03.1.454.CMB.1.raw
tcagacgagtgcgtcacgaccggtgctcgatttagtagtgtagatttgggtttgggggtcagacccagtcaggacacagcatggacatgagggtccccgctcagctcctggggctcctactgctctggttcccaggttccagatgcgacatccagatgacccagtctccatcttccgtgtctgcatctgtcggagacagagtcaccatcacttgtcgggcgagtcagggtattagcagctggttagcctggtatcagcagaaaccagggaaacgcccccaaaactcctgatctatgctgcatccagtttagaaaaggtcggggtacccagtacaaggttcaggcggcaggtggatcgtgggacagtatttcactctcaccatcagcacgcctgcacgcctagaaagttattttacgacttaaagttacttatttacgtaccaaacgaccggtacctaaacgttacgtttaccccgtacggttaaccggttccgggaacccgtaaaggggaaccctaaagggtacggaaaacccgaacgtaacgtggtacggcgtacggaccacctacgtcttcggttccttactaccttaccttccccgtacccc

SEQ ID NO: 213806 - DNA, 469 bp, Homo sapiens
  misc_feature: GYAE6OF02IY44M.1.25.C03.1.454.CMB.1.raw
  modified_base (222)..(222): a, c, t, g, unknown or other
  misc_feature (222)..(222): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (454)..(469): a, c, t, g, unknown or other
  misc_feature (454)..(469): n is a, c, g, or t
tcagacgagtgcgtcacgaccggtgctcgatttagtagtgtagatttgggtttgggggaagtagtcctggatccggcagcccccagggaagggactggagtggattgggtatatccatgatagtgggagcaccaactacaacccctccctcaagagtcgagtcaccatatcacgagacacgtccaagaagcagttctccctgaagctgagctctgtgaccgntgcggacacgggccgtgtattactgtgcgagagaccaagggcaggtgtggacgtcgtggggccaagggaccacggtcaccgtctcctcacgcctccaccaagggccccatccgtccttcccctggccnccctgctccaggncacctcgagancacagcgccctgggctgccgtggtcaacggactaccttcacgcactcgtcgtgacggcgggctggcaagggcacgatagnnnnnnnnnnnnnnnn

SEQ ID NO: 213807 - DNA, 546 bp, Homo sapiens
  misc_feature: GYAE6OF02F4JIA.1.25.C03.1.454.CMB.1.raw
tcagacgagtgcgtcacgaccggtgctcgatttagtagtgtagatttgggtttgggggtcagacccagtcaggacacagcatggacatgagggtccccgctcagctcctggggctcctgctgctctggttcccaggttccagatgcgacatccagatgacccagtctccatcttccgtgtctgcatctgtcggagacagagtcaccatcacttgtcgggcgagtcagggtattagcagctggttagcctggtatcagcagaaaccagggaaacgccccccaaactcctgatctatgctgcatccagtttgaaaagtgggtcccatcaaggttcagcggcagtgatctgggacagatttcactctcaccatcagcagcctgcagcctgaagtattttagctaagttactattgtacaacgaggaccaactacgttttcccctacggaaccgtttcggaccgaaacgggaccaaagggtacggaaacccaaacggaacgtacggtcggactggaccaccgattccgtgttcttctacttccttccccg

SEQ ID NO: 213808 - DNA, 645 bp, Homo sapiens
  misc_feature: GYAE6OF02IPBHC.1.25.C03.1.454.CMB.1.raw
  modified_base (161)..(161): a, c, t, g, unknown or other
  misc_feature (161)..(161): n is a, c, g, or t
  modified_base (164)..(164): a, c, t, g, unknown or other
  misc_feature (164)..(164): n is a, c, g, or t
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
tcagacgagtgcgtcacgaccggtgctcgatttagtagtgtagatttgggtttgggggggaaggagggaagactgacggtcctgccacagcggccctgggctggcctggtcaaggctacttccctacagtgctctgagcgggctggcaaggcgcatagctngcncngctgntctnagcagngcncatcatncagccagtcagctatcncntaccanggtatatctggtcacgngaacgttaaacggcnaaaccncgtactcgngtcgntcgtaacgtcgagtacgtacgtaccgtggtccgtccgtaactcggtacgtcgtccgagccggtaacgtacggtaccggactaacggacctcgtacgtaccttacgtcctacgtaccgtaacgtctaacgggtccgtaccgacgttcgtaccggcgtacggtataccggtagtaccgtcggtacgtacttacgtaccgtaggttacgtaccgttggttaaccttagggttacctacgtaccgtacgggtcttaacgttcggttaaccgggtacgaccgttaacgacgttacggtactacgtacgttacgtaaccgttcggaaccggttactacgaccgtttagcgttacgttacctgtaaccgttcccgtacgttacg

SEQ ID NO: 213809 - DNA, 595 bp, Homo sapiens
  misc_feature: GYAE6OF02HTV2I.1.25.C03.1.454.CMB.1.raw
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (462)..(462): a, c, t, g, unknown or other
  misc_feature (462)..(462): n is a, c, g, or t
tcagacgagtgcgtcacgaccggtgctcgatttagtagtgtagatttgggtttgggggagtcagacccagtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtatttctttagccgttggttgactagcaagaaaccgaggggcgacncccctcagtactcgtagtcttagtggtnctatccgagattcggacgtaagggtcggggtacccagtccgtaggttcaggttggctaggtgacgtacgttacggtacggggaactagtacttaaccgccttaccactaactactacacgcacgtcctagacctacgcctaaggtactnttttacacttaatttacttatgaactaatattacttaactacgtacccgttagtcggtacgttaccggaccggtaagggaaccgtaaggtcggaagtaccgaaccgtacgtggtccggcttacgactaacccg

SEQ ID NO: 213810 - DNA, 420 bp, Homo sapiens
  misc_feature: GYAE6OF02FYCN1.1.25.C03.1.454.CMB.1.raw
  modified_base (405)..(405): a, c, t, g, unknown or other
  misc_feature (405)..(405): n is a, c, g, or t
  modified_base (411)..(420): a, c, t, g, unknown or other
  misc_feature (411)..(420): n is a, c, g, or t
tcagacgagtgcgtcacgaccggtgctcgatttagtagtgtagatttgggtttgggggagacagagtcaccatcacttgtcgggcgagtcagggtattagcagctggttagcctggtatcagcagaaaccagggaaagcccccaaactcctgatctatgctgcatccagtttgaaaagtgggtcccatcaaggttcagcggcagtggatctgggacagatttcactctcaccatcagcagcctgcagcctgaagattttgccaagttactattgtcaacaggccaacagttttcccctcgaacgttcggccaagggaccaaggtggaaaccaaacgaactgtggctgcaccatctgtcttcatcttcccgcctcctcacgcactcgtctgagcggctggcaggcncatagnnnnnnnnnn

SEQ ID NO: 213811 - DNA, 589 bp, Homo sapiens
  misc_feature: GYAE6OF02GCID5.1.25.C03.1.454.CMB.1.raw
  modified_base (547)..(547): a, c, t, g, unknown or other
  misc_feature (547)..(547): n is a, c, g, or t
  modified_base (550)..(552): a, c, t, g, unknown or other
  misc_feature (550)..(552): n is a, c, g, or t
  modified_base (554)..(554): a, c, t, g, unknown or other
  misc_feature (554)..(554): n is a, c, g, or t
  modified_base (557)..(560): a, c, t, g, unknown or other
  misc_feature (557)..(560): n is a, c, g, or t
  modified_base (562)..(563): a, c, t, g, unknown or other
  misc_feature (562)..(563): n is a, c, g, or t
  modified_base (565)..(589): a, c, t, g, unknown or other
  misc_feature (565)..(589): n is a, c, g, or t
tcagacgagtgcgtcacgaccggtgctcgatttagtagtgtagatttgggtttgggggagtcagagtcaccatcacttgtcgggcgagtcagggtattagcagctggttagcctggtatcagcagaaaccagggaaagcccccaaactcctgatctatgctgcatccagtttgaaagtgggtcccatcaaggttcagcggcagtggatctgggacagatttcactctcaccatcagcagcctgcagcctgaagtattttgactaagttactattcgtacaacaggcccaactacgttttcccctacggtaaaccggtttcgggaccctaaggggaacccaaacggggttacgggaaaaaccccaaaacggtaaaccttcggttacgggccttacggacctacccgaattccgttacgtttccgttacctacgtttacccttcccccggacctacttccgtacgaaaccgtccctaaccgtttccggtcgttacgggaacgggtccggggtaccttgggaccgtaaacgggtccggactaagtacggncgnnngngcnnnncnngnnnnnnnnnnnnnnnnnnnnnnnnn

SEQ ID NO: 213812 - DNA, 381 bp, Homo sapiens
  misc_feature: GYAE6OF02GOHHT.1.25.C03.1.454.CMB.1.raw
  modified_base (339)..(339): a, c, t, g, unknown or other
  misc_feature (339)..(339): n is a, c, g, or t
  modified_base (367)..(381): a, c, t, g, unknown or other
  misc_feature (367)..(381): n is a, c, g, or t
tcagacgagtgcgtcacgaccggtgctcgatttagtagtgtagatttgggtttgggggctttccctggtatcagcagaaaccagggaaagcccccaaactcctgatctatgctgcatccagtttgaaaagtggggtcccatcaaggttcagcggcagtggatctgggacagatttcactctcaccatcagcagcctgcagcctgaagattttgctaattttattactgtacaactagtattatacgtacccctagtggtacgttcggccaggggaccaaggtggaagtcaaccgatgtggctgcacatctgtctcatctcccgcatctgacgcactcgntgacgcggctggcaacggcgacatacgnnnnnnnnnnnnnnn

SEQ ID NO: 213813 - DNA, 756 bp, Homo sapiens
  misc_feature: GYAE6OF02IC8MC.1.25.C03.1.454.CMB.1.raw
  modified_base (207)..(207): a, c, t, g, unknown or other
  misc_feature (207)..(207): n is a, c, g, or t
tcagacgagtgcgtcacgaccggtgctcgatttagtagtgtagatttgggtttgggggcaggagtcagacccagtcaggacacagcatggacatgagggtccccgctcagctcctggggctcctgctgctctggttcccaggttccagatgtgacatccagatcgacccagtcctccatcttccgtgtctgctatcgttggacgganacgagtacgtacaacctatctacgtttcgggccgggacgtaacggtcggtaagggttacttaacggacgtacggtccggttagggttacgtccgttaggttaacaccgaggaaccaaaacggaaaacccggaaagggaaaccccaacccctaaacgttccgtagtacttacgaagtcgtacgcgtacctacgtacggttaagtttaaacggaaacgggtttccggaacctagtacgtaacggtcgacggtacgagtaggtcgacgtcgtaacgtacgtagttcgtaccacttctaaccgtaccaagtcgacgtacgtcgtaccgtcgactacgtacgtaagtaacgtttacttacgtaaccttaaagttctacgttaacaccgaaagtacccgaaccttacgttacccgtttaccgtaaccgggttacgtcccgggtaaacgaaccgggtaaccgttaacgggtaaaccgaaaacccgttaacggcggttaacggaccggtacgtacccgtaccgtaacctacgtttaccgttaccgttacttaacccg

SEQ ID NO: 213814 - DNA, 175 bp, Homo sapiens
  misc_feature: GYAE6OF02H9JB1.1.25.C03.1.454.CMB.1.raw
  modified_base (156)..(175): a, c, t, g, unknown or other
  misc_feature (156)..(175): n is a, c, g, or t
tcagacgagtgcgtcacgaccggtgctcgatttagtagtgtagatttgggtttggggggaagaggaagactgacggtcctgccacagcggccctgggctgcctggtcaaggctacttccacgcactcgtctgagcgggctggcaaaggcgcatagnnnnnnnnnnnnnnnnnnnn

SEQ ID NO: 213815 - DNA, 155 bp, Homo sapiens; identical to SEQ ID NO: 213793
  misc_feature: GYAE6OF02FVNCV.1.25.C03.1.454.CMB.1.raw
  modified_base (155)..(155): a, c, t, g, unknown or other
  misc_feature (155)..(155): n is a, c, g, or t

SEQ ID NO: 213816 - DNA, 706 bp, Homo sapiens
  misc_feature: GYAE6OF02IQCFL.1.25.C03.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
tcagacgagtgcgtcacgaccggtgctcgatttagtagtgtagatttgggtttgggggaggaactgctcagttaggacccagagggaaccatggaagccccagctcagcttctcttcctcctgctactctggctcccagatatcaccggagaaattgtgttgacacagtctccagccaccctgtctttgtctccagggaaagngccaccctctcctgcagggccagtcagngtgtcgccctatgcctgtaccngcagaagctggccaggctacccagcctcctcatctctgatgcactaccaacgagggtcacgtgccacgtcccggcgtaggttcaggtggacgtaggtggggtcgtcggggaacacggtaccttacgactcctaccaaccctagtaccacgtacgaacgaccgtaggggacggtaaccgggtaagttagttttcggtacgtttaaggttttaacgtttacgttacgttacgtacgtacgaacggtaaccgtaaaccggtacgttccggtaccgttaccgttaccgttaccggttttaccggggaccggggtaccgggaaccgggtacggggtacgggtacggtaacggtaaccgaacgggtaacggtaaccggttagggtaccgggtaccgttacggacccgttaccgtacgtttccgttaccggtttacctttaccgtacccgtttacccccg

SEQ ID NO: 213817 - DNA, 720 bp, Homo sapiens
  misc_feature: GYAE6OF02HVINQ.1.25.C03.1.454.CMB.1.raw
  modified_base (143)..(143): a, c, t, g, unknown or other
  misc_feature (143)..(143): n is a, c, g, or t
  modified_base (448)..(448): a, c, t, g, unknown or other
  misc_feature (448)..(448): n is a, c, g, or t
tcagacgagtgcgtcacgaccggtgctcgatttagtagtgtagatttgggtttggggggacatgagggtccccgctcagctcctggggctcctgctgctctcggttcccaggttccagatgcgacatccagatcgaccagtcnccatccttccgtgtctgcatcgtggtcggagacagactccaacctatctacgttggtcgggacgtagtacgtagggttaattacgacgacgtcgttaggttacgccgttaggtactcgacgacaaaccggaaacggacgggaaaacccgacccctaaacgttccgtagtacgttactacgtcgcctacgactaacttcgttaaggttaacgggtaaacggttccgggtacctagtacggtaacggtcacggcggtcgaaggtgacgtcggacggaactacgtacttaccacttccgtacacctancgaacgtcgacgtcgacacgtacgtccgtaagttaacgttactttacgtaaccttaaactttacttacgaaccgtactaaacgttacgttaaattacggtacgtagttaccgttacggtaccggttaaccgtccgggaaacggtaaccgggtaacgttagggacgtaacgtacgtaaccgaaacgttcgtagcgtacaccgacctactgttcgtacttcctacgtacccttccgttaccgactttaccgtacgtacctaccgactacgttcg

SEQ ID NO: 213818 - DNA, 504 bp, Homo sapiens
  misc_feature: GYAE6OF02F2PQS.1.25.C03.1.454.CMB.1.raw
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
  modified_base (473)..(474): a, c, t, g, unknown or other
  misc_feature (473)..(474): n is a, c, g, or t
  modified_base (476)..(478): a, c, t, g, unknown or other
  misc_feature (476)..(478): n is a, c, g, or t
  modified_base (480)..(504): a, c, t, g, unknown or other
  misc_feature (480)..(504): n is a, c, g, or t
tcagacgagtgcgtcacgaccggtgctcgatttagtagtgtagatttgggtttgggggagacagagtcaccatcacttgtcgggcgagtcaggccatcagcgattctttagcctggttgcagcagaaaccagggcgagcccctcagatcgtagtctatggtgcatccagattgcaaggtggggtcccatccaggttcagtggcagtgcatctgggacagtattacactctcactatcagcagcctgcagcctagaagtatttgactaatttacttactgtacaactagttaattatacgtacccctacggtggtacgttcggaccgaggggacctaagggtcggaaagtaccgaaaccgactggtcggctgcctacatcgtattcttcacttcccttaccccgccttcccgtacacgtcctacgtccgtctggacgtcgggcgtcggacgtaacggcgacctagtcgncgngnngnnngnnnnnnnnnnnnnnnnnnnnnnnnn

SEQ ID NO: 213819 - DNA, 714 bp, Homo sapiens
  misc_feature: GYAE6OF02JEFW4.1.25.C03.1.454.CMB.1.raw
  modified_base (199)..(199): a, c, t, g, unknown or other
  misc_feature (199)..(199): n is a, c, g, or t
  modified_base (253)..(253): a, c, t, g, unknown or other
  misc_feature (253)..(253): n is a, c, g, or t
tcagacgagtgcgtcacgaccggtgctcgatttagtagtgtagatttgggtttgggggagctgctcagttaggacccagagggaaccatggaagccccagctcagcttctcttcctcctgctactctggctcccagatatcaccggagaaattgtgttgacacagtctccagccaccctgtctttgtctccaggggaangccaccctctctgcagggccagtcagagtgtcggcccctattagcctggtaccngcagaagctggccaggcctccagcctcctcatctctgatgacactccaacgcgggtcacgtggacctaccgtcccggcctaggtttccaagtcgggccgaggttcggggtctcgggggtaactcgtaacttccgaccttccctaccgaaccctagttaccaggtacccgacgacccgttaacggacggtacccgggtaaagttacgttttcgacgttaagttttaaccgttacttacggtctaacggtaccacggttaccgtaaacgtccggttacgggtccctccgtttaccgtaccgtttaccggggcgggtaaccggaccgggttaggggtccggtaaaggtacgttaccggtaaagggcccggttaaaggttcgggttacgggtcccgttaccgggtaaccctaaccccggttagttacccgttagggttttccccttaccgttgtttaccccccgg

SEQ ID NO: 213820 - DNA, 749 bp, Homo sapiens
  misc_feature: GYAE6OF02GXDD7.1.25.C03.1.454.CMB.1.raw
tcagacgagtgcgtcacgaccggtgctcgatttagtagtgtagatttgggtttgggggagtcagacccagtcaggacacagcatggacatgagggtccccgctcagctccgtggggctcctgctgctctggctccaggtgccaaatgtgacatccagatgacccagtctccttccaccctgtctacatctgtaggagacagactacaccatcacttgccggcagtcagagtataacgtgacttggttgcctggtatcagacaagaaccgggagacgacccctaaacgtcctagactactaagtaggcactaccgtaaggtttaacggaacggtcggggtacccagtacccgtaaggttacgacggtaccggactaggtacggtacgttacggtaacggggtaacaaaggttaaacgtttaccaaccgtttacctacccgaaacccgtaccgtttacccggtaacgtaccgtacggtaccgaacggttacccgtaggtaaacgttacggtttagttttacgaaacccgttaaacttttaaacgttaaccgttaccgaaacccgtaaaacttaaaccttttaaatttaacttaacgtaccgttaccgggtacgttaccggtaaccggaacggtaaacgggtaacgggtaacggtaaacgtaaccgtaaacgtaacgtcggtacggtacgtacgtaccgtaacctaacgttcgttacgttccgttacgtaccttaccttccgtaccctaacg

SEQ ID NO: 213821 - DNA, 620 bp, Homo sapiens
  misc_feature: GYAE6OF02FSUMB.1.25.C03.1.454.CMB.1.raw
  modified_base (196)..(196): a, c, t, g, unknown or other
  misc_feature (196)..(196): n is a, c, g, or t
  modified_base (266)..(266): a, c, t, g, unknown or other
  misc_feature (266)..(266): n is a, c, g, or t
tcagacgagtgcgtcacgaccggtgctcgatttagtagtgtagatttgggtttgggggtcagacccagtcaggacacagcatggacatgagggtccccgctcagctcctggggctcctgctgctctggttcccaggttccagatgcgacatccagatgacccagtctccattcttccgtgtctgcatctgtcgganacagacgtccaccatcacgttggtcgggcgagtcaggggttattaggcagtcgttgggttagcctggtancagcaacggaaaccgaaggggaaaccgacccccctaaactcctaggactctatgctgctactctagttagaaaggtcgggaccagtcaaggtcagtcggcaggtgatcggtaggactagtacttcacttcacacatacagcacgtcctgacgacgtcgtagtaattactttacggacttaagtttacttagtactacgaacgacggtacctaacgttccgttaccgtacgtacgttaccggaaccgtaacgggaacgtaacgggtaaccgtaaaccgtaacgtacggtacggtcggtacctacggtacctaacgtacttcgttacggttaccttactaccgttcccgtaccccg

SEQ ID NO: 213822 - DNA, 621 bp, Homo sapiens
  misc_feature: GYAE6OF02G470G.1.25.C03.1.454.CMB.1.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
tcagacgagtgcgtcacgaccggtgctcgatttagtagtgtagatttgggtttgggggtcagacccagtcaggacacagcatggacatgagggtccccgctcagctcctggggctcctgctgctctggttcccaggttccagatgcgacatccagatgacccagtctccatcttccgtgtctgcatctgtcggagacagagtcaccatcacttgtcgggngagtcagggtattagcagctgtancctggtatcagcagaaaccaggaaacncccccaaactcctgatcgtatgctgcatccagtttacgaaaaggtgggtacccagtacgaaggttcaggtacggcgtagtcggagtacgttagggactagtactttacgactcgtactaccatcgaacgcgacgtccctagccacggccttaacggtaagttacgttttcaaccgttaattttaacgtattacgtactaaacgtgtttaaacttactaacgttacccgttaaggtcgttaaccgttccgggaccgaacgggtaccgaagggttacgaacggttaaccggaaccgttaacggacggttacgtcgtacggactaccgtaattccgtacgttcttacgtaccc

SEQ ID NO: 213823 - DNA, 171 bp, Homo sapiens
  misc_feature: GYAE6OF02HHKYS.1.25.C03.1.454.CMB.1.raw
  modified_base (139)..(139): a, c, t, g, unknown or other
  misc_feature (139)..(139): n is a, c, g, or t
  modified_base (155)..(171): a, c, t, g, unknown or other
  misc_feature (155)..(171): n is a, c, g, or t
tcagacgagtgcgtcacgaccggtgctcgatttagtagtgtagatttgggtttgggggaagaggaagactgacggtcctgccacagcggccctgggctgcctggtcaaggactacttccagtactctatctgagcgggntggcaaggcgcatagnnnnnnnnnnnnnnnnn

SEQ ID NO: 213824 - DNA, 168 bp, Homo sapiens
  misc_feature: GYAE6OF02GXBZN.1.25.C03.1.454.CMB.1.raw
  modified_base (156)..(168): a, c, t, g, unknown or other
  misc_feature (156)..(168): n is a, c, g, or t
tcagacgagtgcgtcacgaccggtgctcgatttagtagtgtagatttgggtttggggggaagaggaagactgacggtcctgccacagcggccctgggctgcctggtcaaggactacttccagtactctatctgagcgggctggcaaggcgcatagnnnnnnnnnnnnn

SEQ ID NO: 213825 - DNA, 625 bp, Homo sapiens
  misc_feature: GYAE6OF02JSGBO.1.25.C03.1.454.CMB.1.raw
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (532)..(532): a, c, t, g, unknown or other
  misc_feature (532)..(532): n is a, c, g, or t
  modified_base (554)..(554): a, c, t, g, unknown or other
  misc_feature (554)..(554): n is a, c, g, or t
  modified_base (577)..(577): a, c, t, g, unknown or other
  misc_feature (577)..(577): n is a, c, g, or t
  modified_base (611)..(611): a, c, t, g, unknown or other
  misc_feature (611)..(611): n is a, c, g, or t
tcagacgagtgcgtcacgaccggtgctcgatttagtagtgtagatttgggtttgggggacatgagggtccccgctcagctcctggggctcctgctgctctggttcccaggttccagatgcgacatccagatgacccagtctccattcttccgtgtctgcatctggtcggagacaggatcaccatccacgttggtcgggcagtcgaaggggttatagcagtcttggttacgcctggtactcagacagaaaaccgngggaaaccnccccgaaactcctgactctagtgctgcactccgtagtagtaaaggtcggggtaccagttacgaaggttcgaacggcggacgtgtaggacgttcgtagggacctaggtactttacacttcctacaaccgtattacgaacgcgtaacgtccgttacgaccaacgtcccgtaagaacgtttatttacggactttaaggttacttagtctacgacgtacgactaacgtcttccgacgtacgtcggacgagacgtaagacgtaaaccaacgtgngtacggtcagtccagcttcgtntacttcaaccgttccgtccctanacctacgtacgaccgtcgttaccgccggtttacncggtaccgtacggg

SEQ ID NO: 213826 - DNA, 386 bp, Homo sapiens
  misc_feature: GYAE6OF01DIZ1Y.13.23.C01.1.454.CMB.1.raw
  modified_base (379)..(386): a, c, t, g, unknown or other
  misc_feature (379)..(386): n is a, c, g, or t
tcagtcacgtactacacgaccggtgctcgatttagtacacgtgattagggattgggcttatcaatgccagtgggggcaccagctacaaccctccctcaagagccgcgtcaccatttcagtagacacgtccaagaaccagctctccctgaagctgagttctgtgaccgccgcagacacggccgtgtattactgtgcgcgacaggtggacgtctggggccaaggggaccacggtcaccgtctcctcagcctccaccaagggccatcggtcttcccctggcgccctgctccaggagcacctccgagagcacagcggccctgggctgccctggtcaaggactactcctagtacgtgactgagcgggctggcaaggcgcatagnnnnnnnn

SEQ ID NO: 213827 - DNA, 532 bp, Homo sapiens
  misc_feature: GYAE6OF01DX8XX.13.23.C01.1.454.CMB.1.raw
  modified_base (519)..(520): a, c, t, g, unknown or other
  misc_feature (519)..(520): n is a, c, g, or t
  modified_base (522)..(532): a, c, t, g, unknown or other
  misc_feature (522)..(532): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacgccccaaatcctcatctatactaataatcaccggcctcagggatccctgaccgattctctgcctccaagtctggcacctcagcctccctggccatcagtcggctccagtctgagatgaggctgattattactgtgcagcaatactatcgacaccctgaacttggtcttttggggtcgtttcggcggagggacctaagctcggaccgtcgtacggtcaggcccgaaggcctccgcccccgtcggtccaccgttcctccgttccccgtccctcctctacgtaccgtcgactcggacggcggtcgtcgggcacggcgcagtgnncnnnnnnnnnnn

SEQ ID NO: 213828 - DNA, 491 bp, Homo sapiens
  misc_feature: GYAE6OF01D7QWZ.13.23.C01.1.454.CMB.1.raw
  modified_base (439)..(439): a, c, t, g, unknown or other
  misc_feature (439)..(439): n is a, c, g, or t
  modified_base (483)..(491): a, c, t, g, unknown or other
  misc_feature (483)..(491): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaagctgcccttatcatcacggggcccaggcagagatgaatctgattattactgtgttctttatatgggtagtgcctatttctgctgtgttcggaggaggcacccggctgaccgtcctcggtcacgcccaaggctcgccccatccggtcactctcgtcccnccctcctctagtacgtgactgagcgggctggcaaggcgcatagnnnnnnnnn

SEQ ID NO: 213829 - DNA, 620 bp, Homo sapiens
  misc_feature: GYAE6OF01E4F6H.13.23.C01.1.454.CMB.1.raw
  modified_base (607)..(607): a, c, t, g, unknown or other
  misc_feature (607)..(607): n is a, c, g, or t
  modified_base (611)..(620): a, c, t, g, unknown or other
  misc_feature (611)..(620): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaaccgccccaaatcctcatctatactaataatcaccggccctcgagggactccctgaccgtattcctctcgcctaccaagtctggccacctcacgccctccctggccatccgagtccggctccagtctgagatggaggtctagtatttacttacgtgtacgacgtaagactaaacttaactacgtacgtaaccccgtacccgttaggtaacggtttcggggtttcggttttagggggtcgggtttaccggggaccgggtaaccgggtacctaacgtccgtaccggtacccgttaccggtacggtacgacccgtaccgacgtccgtccccgaccccgtcgtcctaccgtccgttcccgtccccgtcctcctcgtacgtacgtcgacgtcggacggcgcgtcgacgacgcganagtnnnnnnnnnn

SEQ ID NO: 213830 - DNA, 506 bp, Homo sapiens
  misc_feature: GYAE6OF01CB9WG.13.23.C01.1.454.CMB.1.raw
  modified_base (208)..(208): a, c, t, g, unknown or other
  misc_feature (208)..(208): n is a, c, g, or t
  modified_base (332)..(332): a, c, t, g, unknown or other
  misc_feature (332)..(332): n is a, c, g, or t
tcagtcacgtactacacgaccggtgctcgatttagtacacgtgattagggattggggcagcttcggctgtgggtagagaagacaggactcaggacaatctccagcatggccagcttccctctcctcctcaccctcctcactcactgtgcagggtcctgggcccagtctgtgctgactcagccaccctcagcgtctgggacccccgggnagagggtcaccatctcttgttctgaaagcagctccaacaccggaactggtgatataaaactggtaccagcagctcccaggaacggccccaaactcctcatctatactaataatcaccggccctnagggatccctgaccgattctctgcctcaagtctggcacctcagccctccctggccatcagtcgctcagtctgagatgagctgattattactgtgcagcatactatgacacctgaatggtcttgggtgttcggcggaggaccagctgaccgtctaggtcacgcccgaaggtcccg

SEQ ID NO: 213831 - DNA, 531 bp, Homo sapiens
  misc_feature: GYAE6OF01CFJFD.13.23.C01.1.454.CMB.1.raw
tcagtcacgtactacacgaccggtgctcgatttagtacacgtgattagggattggggcagcttcggctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgaaagcagctccaacaccggaactggtgatataaactggtaccagcagctcccaggaaccgcccccaaatcctcatctatactaataatccaccggccctcacgggactccctgaccgtattctctgccctccaagtctggcacctcacgccctccctggccatcagtcgctccagtctgagatgaggctgattattactgtgcagcatactatcgacaccctagaattggttcgtttgggtgttcgggcggagggaccaggcctagacccgttcgtacggtccacgcccgaaggtcccg

SEQ ID NO: 213832 - DNA, 505 bp, Homo sapiens
  misc_feature: GYAE6OF01CJC3B.13.23.C01.1.454.CMB.1.raw
  modified_base (493)..(505): a, c, t, g, unknown or other
  misc_feature (493)..(505): n is a, c, g, or t
tcagtcacgtactacacgaccggtgctcgatttagtacacgtgattagggattgggggccgttcctgggcccagtctgtgctgactcagccacactcagcgtctgggacccccgggcagagggtcaccatctcttgttctgaaagcagctccaacaccggaactggtgatataaaactggtaccagcagctcccaggaacggcccccaaactcctcatctatactaataatcaccggcctcagggatccctgaccgattctctgcctcaagtctggcacctcagcctcctggccatcagtcggctccagtctgaggatgagctgattatactgtgcagcatactatgactaccctgaatggtctttgggtgttcggcggagggaccaagtctgaccgtctaggtcacgccaaggcctcgcccctcggtcactcctcgttccccaccctcctctacgtacgtcgtactgacgcgggctgggctaggcgcagtgnnnnnnnnnnnnn

SEQ ID NO: 213833 - DNA, 387 bp, Homo sapiens
  misc_feature: GYAE6OF01A8V7P.13.23.C01.1.454.CMB.1.raw
  modified_base (379)..(387): a, c, t, g, unknown or other
  misc_feature (379)..(387): n is a, c, g, or t
tcagtcacgtactacacgaccggtgctcgatttagtacacgtgattagggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggaccacggtcaccgtctcctcagcctccaccaagggcccatcggtcttcccctggcgccctgctccaggagcacctccgagagcacagcggccctgggctgcctggtcaaggactactcctagtacgtgactgagcgggctggcaaggcgcatagnnnnnnnnn

SEQ ID NO: 213834 - DNA, 504 bp, Homo sapiens
  misc_feature: GYAE6OF01DE542.13.23.C01.1.454.CMB.1.raw
  modified_base (493)..(498): a, c, t, g, unknown or other
  misc_feature (493)..(498): n is a, c, g, or t
  modified_base (500)..(504): a, c, t, g, unknown or other
  misc_feature (500)..(504): n is a, c, g, or t
tcagtcacgtactacacgaccggtgctcgatttagtacacgtgattagggattgggggccgttcctgggcccagtctgttgctgactcagcccaccctcagcgtctgggacccccgggcagagggtcaccatctacttgttctgaaaagcagctccaacaccggaactggtgatataaactggtaccagcagctcccaggaacggccccaaactcctcatctatactaataatcaccggccctcagggactccctgaccgattctctgcctccaagtctggcacctcagcctccctggccatcagtcggctccagtctgaggatgaggctgatttattactgtgcagcagtactatgacaccctgaatggtctttggggtgttcggcggtagggaccaagctgaccgtctaggtcagcccaaggctgcccctggtcactctcgtttcccgccctctctagtcgtgactgacgcgggctgcaaggcgcatacgnnnnnncnnnnn

SEQ ID NO: 213835 - DNA, 498 bp, Homo sapiens
  misc_feature: GYAE6OF01EW4J1.13.23.C01.1.454.CMB.1.raw
  modified_base (318)..(318): a, c, t, g, unknown or other
  misc_feature (318)..(318): n is a, c, g, or t
  modified_base (379)..(379): a, c, t, g, unknown or other
  misc_feature (379)..(379): n is a, c, g, or t
  modified_base (442)..(442): a, c, t, g, unknown or other
  misc_feature (442)..(442): n is a, c, g, or t
  modified_base (488)..(488): a, c, t, g, unknown or other
  misc_feature (488)..(488): n is a, c, g, or t
  modified_base (490)..(498): a, c, t, g, unknown or other
  misc_feature (490)..(498): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggccccaaactcctcatctatactaataatcaccggccctcagggatccctgaccgattctctgcctccaagtctggcacctcagccctccctggccatcagtcggctccagtctgagntgagctgattattactgtgcagcatactatgacaccctgaatggtctttggggtgttcggnggagggaccaagctgaccgtctaggtcagcccgaagctcgcccctcggtcactctcgttcccnccctctctagtacgtcgactgagcggtctgggcaggcgcagtagcngnnnnnnnnn

SEQ ID NO: 213836 - DNA, 560 bp, Homo sapiens
  misc_feature: GYAE6OF01DND1W.13.23.C01.1.454.CMB.1.raw
  modified_base (389)..(389): a, c, t, g, unknown or other
  misc_feature (389)..(389): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
tcagtcacgtactacacgaccggtgctcgatttagtacacgtgattagggattggggctgggagaggagccccagccgtgagattcccaggagtttccacttggtgatcagcactgaacacagaccaccaaccatggagtttgggcttacttgggttttccttgttgcttattttaaaaggtgtccaatgtgagctgcagctggtggagtctggggggaggtttggtacagccaggggcggtccctgagactctcctgtataacttctggattcaacttgggtgattatgctatgaactggtccgccaggctccgaggggaaggggctgggagtggggtaggtttcagttaggagcaagttctcatgatgggacaacagaatacgccgngtctaggtaaaagcaagnttcacatctanaagagatgagtccaagaagcatcgtcctttctgcagatgagtacgcctagaagaccgaggacacgagaccatctacgttatggtcgtactaaggagtagttagtttacgaccgtacgttacccgtaacgtccgtcggtacgg

SEQ ID NO: 213837 - DNA, 610 bp, Homo sapiens
  misc_feature: GYAE6OF01BBV0H.13.23.C01.1.454.CMB.1.raw
  modified_base (598)..(598): a, c, t, g, unknown or other
  misc_feature (598)..(598): n is a, c, g, or t
  modified_base (603)..(610): a, c, t, g, unknown or other
  misc_feature (603)..(610): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccgttggaacaaagctgccccttatcatcgaccgggggcccaggccagaagatagaatctagtattattactgttcgtttactttaagtagttgggttagtgtcctattttctgtccttggttggttcgggtagggacggaccgtacccgggctcggacccgttccgtccggtcctaacggcccgaaacggtccgtaccgccccgtacgttcccggtcctaaccgttccttccggttccccctaccccttcccttacccgttacggtacccgttggtaccgtggacgggtccggccggtcgggcgaaaccgggtccggactagtacggncgagnnnnnnnn

SEQ ID NO: 213838 - DNA, 153 bp, Homo sapiens
  misc_feature: GYAE6OF01B5EPV.13.23.C01.1.454.CMB.1.raw
  modified_base (150)..(153): a, c, t, g, unknown or other
  misc_feature (150)..(153): n is a, c, g, or t
tcagtcacgtactacacgaccggtgctcgatttagtacacgtgattagggattgggcttatcaatgccagtgggggcaccagctacaacccctccctcaagagccgcgtcaccatttcagtagacacgtccaagaaccagctctccctgnnnn

SEQ ID NO: 213839 - DNA, 518 bp, Homo sapiens
  misc_feature: GYAE6OF01EX0U5.13.23.C01.1.454.CMB.1.raw
  modified_base (502)..(507): a, c, t, g, unknown or other
  misc_feature (502)..(507): n is a, c, g, or t
  modified_base (512)..(518): a, c, t, g, unknown or other
  misc_feature (512)..(518): n is a, c, g, or t
tcagtcacgtactacacgaccggtgctcgatttagtacacgtgattagggattgggggccgttcctgggcccagtctatgctgactcagccaccctcagcgtctgggacccccgggcagagggtcaccatctcttgttctgaaagcagctccaacaccggaactggtgatataaactggtaccagcagctcccaggaacggcccccaaacagctcatctataggaataatcagcggccctcaggggtccctgaccgattctctggctccaagtctggcacctcagcctccctggccatcagtgggctccggtccgaggatgaggctgatttattactgtgcagcatggatgacagcctgagtggtcggtgttcggcggaggaccaagcgtgaccgtctaggtcacgcccaaggctcgcccccgtggtccacttccgtcgttcccccacccgttcctactacgtcgtgacgtgacggcgggctggcgaaggcgctagtagcgnnnnnnacgtnnnnnnn

SEQ ID NO: 213840 - DNA, 548 bp, Homo sapiens
  misc_feature: GYAE6OF01BT54T.13.23.C01.1.454.CMB.1.raw
  modified_base (317)..(317): a, c, t, g, unknown or other
  misc_feature (317)..(317): n is a, c, g, or t
  modified_base (513)..(513): a, c, t, g, unknown or other
  misc_feature (513)..(513): n is a, c, g, or t
  modified_base (535)..(548): a, c, t, g, unknown or other
  misc_feature (535)..(548): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggccccaaatcctcatctatactaataatcaccggccctcagggatccctgaccgattctctgcctccaagtctggcacctcagcctccctggccatcagtcggctccagtctgacgntgaggctgattattactgtgcagcatactatcgactaccctgaacttggtcgtttggggtcgttcgggcggacgggacctagcgtcgaccgttccgtaggctacgacccgaaggccgtacccgcccccgttcggtccaccgttccgtaccgtttccccacccgttcctactgtaccgtcgacttggacgttcgggngtcggcgaggccgacagtacgnnnnnnnnnnnnnn

SEQ ID NO: 213841 - DNA, 265 bp, Homo sapiens
  misc_feature: GYAE6OF01B1FWY.13.23.C01.1.454.CMB.1.raw
  modified_base (262)..(265): a, c, t, g, unknown or other
  misc_feature (262)..(265): n is a, c, g, or t
tcagtcacgtactacacgaccggtgctcgatttagtacacgtgattagggattggggcggaaggtatagcagtggcacgtactactttgactactggggccagggaaccctggtcaccgtctcctcagcctccaccaagggcccatcggtcttccccctggcaccctcctccaagagcacctctgggggcacagcggccctgggctgcctggtcaaggctacttcctagtacgtgactgagcgggctggcaaggcgcatagnnnn

SEQ ID NO: 213842 - DNA, 524 bp, Homo sapiens
  misc_feature: GYAE6OF01A8B8X.13.23.C01.1.454.CMB.1.raw
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagtcacgtactacacgaccggtgctcgatttagtacacgtgattagggattggggctgggagaggagccccagccgtgagattcccaggagtttccacttggtgatcagcactgaacacagaccaccaaccatggagtttgggcttacttgggttttccttgttgcttattttaaaaggtgtccaatgtgagctgcagctggtggagtctgggggaggtttggtacagccagggcggtccctgagactctcctgtatacttctggattcaacttgggtgattatgctatgaactgggtccgccaggctccgaggggaggggctggagtggggtaggtttcagttaggganctaattcncatgatgggaacaacgagaatacgccgcgtctaggtaaaagcaagattcaccatcacaaganatgatccaagaancatcgtcctttcngcagntgagtagcctagaacgaccgagacacacgcatctatactgtcgntagngatntcgacagtcctacgctgcg

SEQ ID NO: 213843 - DNA, 749 bp, Homo sapiens
  misc_feature: GYAE6OF01DLQTR.13.23.C01.1.454.CMB.1.raw
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
tcagtcacgtactacacgaccggtgctcgatttagtacacgtgattagggattggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctgggtggagtcgtgggggaggtttggtacagccaggggcgtccctggagactctcctgtaataacttctggattcaacttgggtntattangctatgaactggtccncagctcgagggagggntggagtgggtaggttcagtaggagctaattctacgtatggattggggaactaacgagtaagtacgccggacgtcgttaaggtaaaaggcctaaggtactttaccgaaccctattacctaacgtaaaggacgtaagtacggtaacggttaccgaaggaaacgcccgtaatcccgggtttccctttttaccgcggtacctaaggtacgttacgggaacggttaacggtaccgtaacgggaaacgggtacccggaaacggggaccttaaaccgacgggtccctaaacgtttacccttaaggtttttaaccgtacgggttaacgttcccggttaaagggtaacggttaaacggttttacgtttacgggtaccccggttaaacggtttacccccgtttaaaccccggtcccgtttagggttaaaccccggg

SEQ ID NO: 213844 - DNA, 589 bp, Homo sapiens
  misc_feature: GYAE6OF01B2FJI.13.23.C01.1.454.CMB.1.raw
  modified_base (324)..(325): a, c, t, g, unknown or other
  misc_feature (324)..(325): n is a, c, g, or t
  modified_base (569)..(569): a, c, t, g, unknown or other
  misc_feature (569)..(569): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(589): a, c, t, g, unknown or other
  misc_feature (586)..(589): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacgcccccaaactcctcatctatactaataatcaccggccctcagggatccctgaccgtattctctgcctccaagtctggccacctcacgccctccctcggccactcagtcggctccagtctgaggnngaggctgattattactgtgcagcatactatcgacaccctgaacttggttcgtttgggtgttacggcggagggaccagctcgaccgtccgtacggtcacgacccgaacggtccgtaccgtcccccgtcggtaccctaccgttccgttcccggtttcccccgtcccttcccgttccgttaacggtaccgttcgacgttacggacggtccgggcgttacgggacgaacgggccgacgtacgtacgtnacgtgngntgctncngnnnn

SEQ ID NO: 213845 - DNA, 762 bp, Homo sapiens
  misc_feature: GYAE6OF01CUZMS.13.23.C01.1.454.CMB.1.raw
  modified_base (326)..(326): a, c, t, g, unknown or other
  misc_feature (326)..(326): n is a, c, g, or t
  modified_base (746)..(746): a, c, t, g, unknown or other
  misc_feature (746)..(746): n is a, c, g, or t
  modified_base (755)..(755): a, c, t, g, unknown or other
  misc_feature (755)..(755): n is a, c, g, or t
  modified_base (757)..(758): a, c, t, g, unknown or other
  misc_feature (757)..(758): n is a, c, g, or t
  modified_base (760)..(760): a, c, t, g, unknown or other
  misc_feature (760)..(760): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacacgaccccaggcaggcctccgcgcacgctcatctacaacacaaacactcgctcttcgtcggggtccctctactcgtcttcctcttcgggccttcccaactttcccgttaggggaaaaccaaacggcttcgtacccctttacncgtactccggacccggggggcccacgggcgaacggaaaggtactaagtaactcgtagttaatttacttacttgtttagttttacttttagtagttacgggttacgttcgtaccttgttttaccgtgtcgtttggttacggtttaccggggagggtaccgggtccgaccccgggtccgttaccggtacccgttcccggttccggttaccgaacggtaccccggaacggtcccgtccccggtacccccgtacgttaccccgggttacctaaccctttcccgtttacccccggtttccccctaaccccggtttccccgtttacgttaaccgggtttccgttaaccgtacggtttcgggaacgggtccggggtccgttacgggggaaccgaccggggtcggtaacccgtagtaacgtcctgacnccggtaacnanngncg

SEQ ID NO: 213846 - DNA, 423 bp, Homo sapiens
  misc_feature: GYAE6OF01BGF1J.13.23.C01.1.454.CMB.1.raw
  modified_base (97)..(97): a, c, t, g, unknown or other
  misc_feature (97)..(97): n is a, c, g, or t
  modified_base (118)..(118): a, c, t, g, unknown or other
  misc_feature (118)..(118): n is a, c, g, or t
  modified_base (243)..(243): a, c, t, g, unknown or other
  misc_feature (243)..(243): n is a, c, g, or t
  modified_base (370)..(423): a, c, t, g, unknown or other
  misc_feature (370)..(423): n is a, c, g, or t
tcagtcacgtactacacgaccggtgctcgatttagtacacgtgattagggattgggggccgttcctgggcccagtctgtgctgactcagccaccctnagcgtctgggaccccccgggnagagggtcaccatctcttgttctgaaagcagctccaaacaccggaactggtgatataaactggtaccagcagctcccaggaaccgccccaaatcctcatctatactaaataatcaccggccctanagggtactcccgtagaccgtattcctcttgcctaccaagtctggcacctcagccctcctggccatcagtcggctccaagtctaggagatgaggctgattaattctgtgcagctaagtacttaacgtnnnnnnnnnnnnnnnnnnnnnnnnnnnnnnnnnnnnnnnnnnnnnnnnnnnnnn

SEQ ID NO: 213847 - DNA, 737 bp, Homo sapiens
  misc_feature: GYAE6OF01DNSHH.13.23.C01.1.454.CMB.1.raw
  modified_base (325)..(325): a, c, t, g, unknown or other
  misc_feature (325)..(325): n is a, c, g, or t
tcagtcacgtactacacgaccggtgctcgatttagtacacgtgattagggattggggctgggagaggagccccagccgtgagattcccaggagtttccacttggtgatcagcactgaacacagaccaccaaccatggagtttggctttacgttggttttcctgttgacttattttaaaaggtgtccaatgtgagctgcagcgtgggtggagtcggtgggggtagtttggacaggccgagggccggtcctgacgactctcctgtactaacttcgtaggacttcgaagttgggtagtattagtgtactagtgtaacgtcgggtcccnccgaggcgtacccggaggggaacgggcgtagggaggttagggttacggtttactaaggttaaggacgtactaaagtttcgacgtaagttggagtacgggaactaaacgaagtaacgtacggcccgagttacgtaagtaaaacggcaagtacttaccgaaccacttacgaactaaggagtacgtaggaacgtaccgaaggaacgtacgtacgttacccggttaccctttacgtaccgaacgtaggttaacgtcgggaacggttaccgtaaccggtaaggaaaccgggtaaccgaacgggaaaccaacgtacccggacctaacgttaccttaacgttaccgttaggtacccgtaagtaacggtaaggttagttacttacggtacgtacgtacccgtaccgtaccgtgtaacggg

SEQ ID NO: 213848 - DNA, 452 bp, Homo sapiens
  misc_feature: GYAE6OF01DTW1B.13.23.C01.1.454.CMB.1.raw
  modified_base (409)..(409): a, c, t, g, unknown or other
  misc_feature (409)..(409): n is a, c, g, or t
  modified_base (411)..(452): a, c, t, g, unknown or other
  misc_feature (411)..(452): n is a, c, g, or t
tcagtcacgtactacacgaccggtgctcgatttagtacacgtgattagggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaagggccacggtcaccgtctcctcagcctccaccaagggccccatccggtcttccccctggccgccctgcctccaagagccacctcgtcggggggcacgacgcgggccctggggcctcggccgttggtcaaaggtactacttcctaagtacgtgactggagcgggactcggacgaaggcgacgaataggntnnnnnnnnnnnnnnnnnnnnnnnnnnnnnnnnnnnnnnnnnn

SEQ ID NO: 213849 - DNA, 534 bp, Homo sapiens
  misc_feature: GYAE6OF01AISI7.13.23.C01.1.454.CMB.1.raw
  modified_base (378)..(378): a, c, t, g, unknown or other
  misc_feature (378)..(378): n is a, c, g, or t
  modified_base (504)..(504): a, c, t, g, unknown or other
  misc_feature (504)..(504): n is a, c, g, or t
  modified_base (524)..(534): a, c, t, g, unknown or other
  misc_feature (524)..(534): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactacccccagctggtaccaacagaccccaggccaggcctccgcgcacgctcatctacaacacaaacactcgctcttctcggggtccctcatccgcttctctcggctccatccttaggggaacaaagctgcccttatcatcgacggggcccaggcagaagatgaatctgatttattactgtgtttctttatagtgggtagtgtcctatttctgtntgttggttcgggaggtacggccacccggctgacccgtctcggtcacgcccgaaggcctcgcccatcggtctacttctacgttcccctaccctccctctacgtaccgtgtacctggacggcgggtcnggtcgaacggcgcgtatcgnnnnnnnnnnn

SEQ ID NO: 213850 - DNA, 315 bp, Homo sapiens
  misc_feature: GYAE6OF01BC1X7.13.23.C01.1.454.CMB.1.raw
  modified_base (276)..(315): a, c, t, g, unknown or other
  misc_feature (276)..(315): n is a, c, g, or t
tcagtcacgtactacacgaccggtgctcgatttagtacacgtgattagggagttgggggcggaaggtatagcagtggcacgtacttactttgactactggggccagggaaccctggtcaccgtctcctcagccctccaccaaggcccatcggtcttccccctggctccctcctccaagagcacctctgggggcacagcggccctgggctgccgtgggtcaaagggtactacgttccgtagtacgtgacgtgaggcgggctggcaagggcgcatagnnnnnnnnnnnnnnnnnnnnnnnnnnnnnnnnnnnnnnnn

SEQ ID NO: 213851 - DNA, 858 bp, Homo sapiens
  misc_feature: GYAE6OF01E5POL.13.23.C01.1.454.CMB.1.raw
tcagtcacgtactacacgaccggtgctcgatttagtacacgtgattagggattggggctgggagaggagccccagccgtgagattccccaggagtttcccacttggtgatcagcactgaacacagaccaccaaccatggagtttggcttacgttgggttttccttgttgcttaattttaaaaggtgtaccaatgtgagtctgcagcgtggtggagtcggtggggtaggtttgacaggccgtagggccgtcctgaacgtcctctcctagttactaaccgttctaggtactttcgtaaacgtttgggtataagtttactagtcttacgtacgtaaccgtcggggttccccaccggtacggtcctacccgggtaaggggaacggggtccgtagggtaaggtttggggttaacggttttaccgttaaggttaacgggtaacgtaccgttaaacgtttccgtacgtaacggttagttaacgggtacgggtaaacccgaaaacgttaaacgggaaaaccgttacccgggtaccccggttacttaacggttaaaggtaaaaaaccgggcgtaaaccggtttactaacccgtaaccgttaactacgtaaccggtaaacgaacggtaacgtttacgggaacgtaaacccgtaaaggaaaccggtaccgtacggttaccccgttaccgttttacgaacggtctaacggtagtaacggtaaccgtaccggtaacgtaacggaaccgggtaaccggaaccggtaacaacccgtacggaccctagttactacgttacgtaggtacctaaggtacgtagtacgttgtaccgtacggttaacccgttacccgtaacgttccgtcggttacggg

SEQ ID NO: 213852 - DNA, 861 bp, Homo sapiens
  misc_feature: GYAE6OF01ASG8H.13.23.C01.1.454.CMB.1.raw
  modified_base (233)..(233): a, c, t, g, unknown or other
  misc_feature (233)..(233): n is a, c, g, or t
  modified_base (595)..(595): a, c, t, g, unknown or other
  misc_feature (595)..(595): n is a, c, g, or t
  modified_base (613)..(613): a, c, t, g, unknown or other
  misc_feature (613)..(613): n is a, c, g, or t
  modified_base (681)..(681): a, c, t, g, unknown or other
  misc_feature (681)..(681): n is a, c, g, or t
tcagtcacgtactacacgaccggtgctcgatttagtacacgtgattagggattggggcagcttcggctgtgggtagagaagacaggactcaggacaatctccagcatggccagcttccctctcctcctccaccctcctcactctactgtcgcacgggtccgtcggggccccaggttcctggtcgtctacgactcgacgcccacctcacggtccgtcgtaccgggacccccggngaggacgggtaccaccgtattccttcgtttgttacgagaaacgctacggtaccctaccaaccgaaccggtaagttcggtaacgtaacttaacgtaaacccgtggtaacccgaacgtaccgtacgtacccccgtaaccggaaaacccggggtaaccccccggaaccccccttaaacccgttccccgttaacgtaacctttaaccggtaaactttaaacctttaaacgtaaacccgttacccgaacccccggggttaccccgtacgggtaaaaccgggtcctttaccccggtacggacccgttaacttttaccggtcccttacggtacccctaacgtacggtacttaccggaccctaccgtacnccccgtcccgttaccccnggtaacccagtcccgtacggacgtccctcgtacgtacggtagaccgtagtaccgggtatccgtaagtnttaacgtcttgggaacctagtaactacttaacctaagaccgtttaccgaacgtacgttacggtcggttacgggttatttacggggtcccggtaagggtaccgggtaacgtaccgtaacggtcccgtacgtttaaacccggccgttaacggtacccaccgggtaccgtacccgttccccgg

SEQ ID NO: 213853 - DNA, 823 bp, Homo sapiens
  misc_feature: GYAE6OF01CV3YP.13.23.C01.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
tcagtcacgtactacacgaccggtgctcgatttagtacacgtgattagggattggggcagcttcggctgtgggtagagaagacaggactcaggacaatctccagcatggccagcttccctctcctcctcaccctcctcactcactgtcgcagggtcctgggcccagtctgtgcctgactcacgccaccgtnacgtcgtcgccggggaccccgnacggacggtcaccatcttcgttcgttcagaaacggctacgacctaaccgaccgtaccggaattgggtacaaacgttaaactaaacgtttgggaacccaggacctacggtcccctaaccggaacggtacccccggtacccctaaacgttcccacttataccgtaattaaccggtaaactactacccgaccggccctaaggaccggttacctacccggtagtaccgttaactttccgtactacccggtaaccctttaccgtaaggttccccggtacgtaaccccgtccgttacccggtacccgcccccgtttccggttaacggcccgttaaacgttccggtaccggttcccggtccgtacccgttaggtaccgtacggggtacgtacggttcggaaccgggttacgtttaacggttactttaacgtttcggacggtttcgaacggtaacttaccgttactaaacggttaccgtccgtaaaccgttcccgttaggtaacggtttcgggtttacgggttacggttcccggtagggggaacgtaccgggtaaatccggtccggttaaccggtaccgtacccggtagacccgaccgggtccgtcccggtaccccgg

SEQ ID NO: 213854 - DNA, 693 bp, Homo sapiens
  misc_feature: GYAE6OF01CBQL9.13.23.C01.1.454.CMB.1.raw
  modified_base (675)..(675): a, c, t, g, unknown or other
  misc_feature (675)..(675): n is a, c, g, or t
  modified_base (683)..(683): a, c, t, g, unknown or other
  misc_feature (683)..(683): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
tcagtcacgtactacacgaccggtgctcgatttagtacacgtgattagggattgggggccgttcctgggcccagtctgtgctgactcagccaccctcagcgtctgggacccccggcagaggtcaccatctcttgttctgaaagcagctccaacaccggaactggtgatataaactggtaccagcagctccaggaaccgccccaaactcctacatctataactaataatccaccggcctacgagggactccctagaccgtattctctcgcctccaagtctcggcctacctcacgccctccgtggccatcgacgtcggcctaccgagtccgtagacggagttggacggtccttaggtatttaacgtttaccgtggttacgacgtacgtactaataaccttagtaccgacctaaccgttagtaacgtttcgggtttagttttcggggtacggtttaccggggacgggtaacgggtaaccaacggtacgtaccgggtacccgttaccggtacggtaccgtacggacccgtaacggtccgtacccggtcccccgttacggtaccctaccgtccgttacccggttccccgtacccttccgttacgtaccggttacgtcggtacgtacgggacgtcgggtcgtaccggacgtaccggccgtacgtaaagtcgtgcctaggcncgcgcacncacncngcnc

SEQ ID NO: 213855 - DNA, 692 bp, Homo sapiens
  misc_feature: GYAE6OF01DAYCM.13.23.C01.1.454.CMB.1.raw
  modified_base (321)..(321): a, c, t, g, unknown or other
  misc_feature (321)..(321): n is a, c, g, or t
  modified_base (405)..(405): a, c, t, g, unknown or other
  misc_feature (405)..(405): n is a, c, g, or t
  modified_base (654)..(654): a, c, t, g, unknown or other
  misc_feature (654)..(654): n is a, c, g, or t
  modified_base (670)..(670): a, c, t, g, unknown or other
  misc_feature (670)..(670): n is a, c, g, or t
  modified_base (689)..(689): a, c, t, g, unknown or other
  misc_feature (689)..(689): n is a, c, g, or t
tcagtcacgtactacacgaccggtgctcgatttagtacacgtgattagggattgggggccgttcctgggcccagtctgtgctgactcagccaccctcagcgtctgggaccccccggcagagggtcaccatctcttgttctgaaacgcagctaccaacaccggaactggtagaataactaaacgtggtaccagcagcctacccaggaaccggcccccaaatccctcaatctaactaactaaagtaacgtacacccggtaccctacgacgggacttcccaggaacctacgttcctgaccgccctacaagttcgtcgacacctnacgccctcccgtagaccatcgacgtccggcttaccgagtcgtagaggactgacggtctagtaactttgaacgtgaggactaganacgttaactactagacccaccgtaggtaatcggtttacgtggttacggtacggacggtacgaacagacgttacgaccgttacgttacgcgaacgttacccgaagtcccgtaccgtcccctacgggtaaccctcctaccgttaccgtttacccccgacccttacgttaccgtaaccggaacgtcggtaacccgttgggaacgggcccgttaacggtcccggaaacgtaccgggtaaccggaccgttaaanacgtagacacgtacgngactagacgacctgactgngta

SEQ ID NO: 213856 - DNA, 491 bp, Homo sapiens
  misc_feature: GYAE6OF02I0KJ2.13.23.C01.1.454.CMB.1.raw
  modified_base (477)..(477): a, c, t, g, unknown or other
  misc_feature (477)..(477): n is a, c, g, or t
  modified_base (481)..(491): a, c, t, g, unknown or other
  misc_feature (481)..(491): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggccccaaactcctcatctatactaataatcaccggccctcagggatccctgaccgattctctgcctccaagtctggcacctcagcctcctggcccatcagtcggctccagtctgaggatgaggctgattattactgtgcagcatactatgacaccctgaatggtctttgggtgttcggcggagggaccaagctgaccgtctaggtcagccaaggctcgcccctcggtcactctcgttcccaccctcctctagtacgtgactgagcggctggcaggcnatgnnnnnnnnnnn

SEQ ID NO: 213857 - DNA, 495 bp, Homo sapiens
  misc_feature: GYAE6OF02GU4IP.13.23.C01.1.454.CMB.1.raw
  modified_base (484)..(495): a, c, t, g, unknown or other
  misc_feature (484)..(495): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggccccaaatcctcatctatactaataatcaccggccctcagggatccctgaccgattctctgcctccaagtctggcacctcagcctccctggccatcagtcggctccagtctgaggatgaggctgattattactgtgcagcatactatgacacctgaatggtctttgggtgttcggcggagggaccaagctgaccgtctaggtcacgccaaggctcgcccctcggtcactctcgttcccaccctcctctacgtacgtgactgagcgggctggcaggcgcatagnnnnnnnnnnnn

SEQ ID NO: 213858 - DNA, 490 bp, Homo sapiens
  misc_feature: GYAE6OF02F3VDA.13.23.C01.1.454.CMB.1.raw
  modified_base (475)..(475): a, c, t, g, unknown or other
  misc_feature (475)..(475): n is a, c, g, or t
  modified_base (481)..(490): a, c, t, g, unknown or other
  misc_feature (481)..(490): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggacaaagctgcccttatcatcacggggcccaggcagaagatgaatctgattattactgtgttcttatatggtagtgcctatttctgctgtgttcgggaggaggcacccggctcgaccgtcctcggtcagcccaaggctgccccatcggtcactctcgttcccgccctcctctagtcgtgactgagcgggctggcaaggcncatagnnnnnnnnnn

SEQ ID NO: 213859 - DNA, 505 bp, Homo sapiens
  misc_feature: GYAE6OF02HKF2G.13.23.C01.1.454.CMB.1.raw
  modified_base (492)..(492): a, c, t, g, unknown or other
  misc_feature (492)..(492): n is a, c, g, or t
  modified_base (496)..(505): a, c, t, g, unknown or other
  misc_feature (496)..(505): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaaacactcgctcttctggggtccctcatcgcttctctggctccatccttgggaacaaagctgcccttatcatcacgggggcccaggcagaagatgaatctgattattactgttgttctttatatgggtagtgcctatttctgctgtgttcggaggtaggcacccggctcggacccgtcctcggtcacgcccaaggctgccccatcggtcactctcgttccccacccttcctctagtacgtgactgagccgggctggcaaggccgacntagnnnnnnnnnn

SEQ ID NO: 213860 - DNA, 497 bp, Homo sapiens
  misc_feature: GYAE6OF02IB073.13.23.C01.1.454.CMB.1.raw
  modified_base (305)..(305): a, c, t, g, unknown or other
  misc_feature (305)..(305): n is a, c, g, or t
  modified_base (481)..(481): a, c, t, g, unknown or other
  misc_feature (481)..(481): n is a, c, g, or t
  modified_base (486)..(497): a, c, t, g, unknown or other
  misc_feature (486)..(497): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggccccaaactcctcatctatactaataatcaccggccctcagggatccctgaccgattctctgcctccaagtctggcacctcagcctccctggccatcagtcggntccagtctgaggatgaggctgattatactgtgcagcatactatgacaccctgaatggttctttgggtgttcggcggagggaccaagctgaccgtctaggtcagccaaggctgcccctcggtcactctcgttcccgccctcctctacgtacgtgacttgacgcgggctggcaaggcncatgnnnnnnnnnnnn

SEQ ID NO: 213861 - DNA, 532 bp, Homo sapiens
  misc_feature: GYAE6OF02JQUDX.13.23.C01.1.454.CMB.1.raw
  modified_base (379)..(379): a, c, t, g, unknown or other
  misc_feature (379)..(379): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (521)..(523): a, c, t, g, unknown or other
  misc_feature (521)..(523): n is a, c, g, or t
  modified_base (525)..(532): a, c, t, g, unknown or other
  misc_feature (525)..(532): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaatcctcatctatactaataatcaccggccctcagggatccctgaccgattctctgcctccaagtctggcacctcacgcctccctggccatcagtcggctccagtctgaggatgaggctgattattactgtgcagcatactatgaacctacctgaagttggtctttggggtntttcgggacggacgggtaccaagctgaccgtccgtaggtcacgccgaaggctcgccccgtcggtctacctctccgttcccgccctcctctacggtcgtcgtaccgtgcggacggctcggctaacggcgcagtacggntncgnnngnnnnnnnn

SEQ ID NO: 213862 - DNA, 531 bp, Homo sapiens
  misc_feature: GYAE6OF02GVNS5.13.23.C01.1.454.CMB.1.raw
  modified_base (518)..(531): a, c, t, g, unknown or other
  misc_feature (518)..(531): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaattggtcttttgggtcgttcggcgggtagggaccaagcgtcgaccgtccgtagggtcacgacccaaggctcgcccctcggtccactctcgttcccacccttccctctacgtacgtcgtacctggacgcgggctcgggaccaagggccgcgactacggnnnnnnnnnnnnnn

SEQ ID NO: 213863 - DNA, 502 bp, Homo sapiens
  misc_feature: GYAE6OF02GEEUH.13.23.C01.1.454.CMB.1.raw
  modified_base (488)..(492): a, c, t, g, unknown or other
  misc_feature (488)..(492): n is a, c, g, or t
  modified_base (495)..(502): a, c, t, g, unknown or other
  misc_feature (495)..(502): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaatcctcatctatactaataatcaccggcctcagggatccctgaccgattctctgcctccaagtctggcacctcagcctcctggccatcagtcggctccagtctgaggatgaggctgattattactgtgcagcatactatgacacctgaatggttctttgggtgttcggcggagggacaagctgaccgtctaggtcacgccaaggctcgcccctcgtcactctcgttcccgccctcctctagtacgtgactgacgcgggctcggacgaggccgacagtagnnnnncgnnnnnnnn

SEQ ID NO: 213864 - DNA, 580 bp, Homo sapiens
  misc_feature: GYAE6OF02I4OTB.13.23.C01.1.454.CMB.1.raw
  modified_base (208)..(208): a, c, t, g, unknown or other
  misc_feature (208)..(208): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
tcagtcacgtactacacgaccggtgctcgatttagtacacgtgattagggattggggcagcttcggctgtgggtagagaagacaggactcaggacaatctccagcatggccagcttccctctcctcctcaccctcctcactcactgtgcagggtcctgggcccagtctgtgctgactcagccaccctcagcgtctcgggacccccggnagagggtcaccatctcttgttctggaagcagctccaacatcggaagtaattatgtatattggtatcagcagctcccaggaaccggcccccaaanagctcatctataggaataatcagcggcctcgaggggtcccngaccgattctctggctacaagtctggccacctcacgcctcccgtggcctatcagtcgggcctcccggtcgaggtacgtggacgtccgtgtatttagttacctggtcgcgagtcagttgggatcgacaggtccctaggtacggttcgggttcccgggtaggttccggggacggggtaacgggacccaagggtcgtacgggtacccgttccggtaagggtaccgacgtccccgaacggg

SEQ ID NO: 213865 - DNA, 525 bp, Homo sapiens
  misc_feature: GYAE6OF02I5TNC.13.23.C01.1.454.CMB.1.raw
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (517)..(525): a, c, t, g, unknown or other
  misc_feature (517)..(525): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactacccccagctggtaccaaccgaccccaggccaggctccgcgcacgctcatctacaacacaaacactcgctcttctggggtccctcatcgcttctctggctccatccttggaacaaagctgcccttatcatcacggggcccaggcagaagatgaatctgtattattactgtgttctttatagtgggtagtgcctatttctgtctgtgttcggaggagcacccgactcgaccgtccgtcgtcacgaccgaacggcctccgaccccgtgtccacttccgtccgttccccgtccctccgtacttacgtacgtcgaactgacggtcgggcgtggacgacggcgacagtagncnncnnnnnnnnn

SEQ ID NO: 213866 - DNA, 503 bp, Homo sapiens
  misc_feature: GYAE6OF02FY63H.13.23.C01.1.454.CMB.1.raw
  modified_base (372)..(372): a, c, t, g, unknown or other
  misc_feature (372)..(372): n is a, c, g, or t
  modified_base (489)..(489): a, c, t, g, unknown or other
  misc_feature (489)..(489): n is a, c, g, or t
  modified_base (491)..(495): a, c, t, g, unknown or other
  misc_feature (491)..(495): n is a, c, g, or t
  modified_base (497)..(503): a, c, t, g, unknown or other
  misc_feature (497)..(503): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggccccaaactcctcatctatactaataatcaccggccctcagggatccctgaccgattctctgcctccaagtcctggcacctcagcctccctggccatcagtcggctccagtctgaggatgaggctgattattactgtgcagcatacatgacacctgaatggtctttgggtntttcggcggtagggaccaagctgaccgtcctaggtcagcccaaggctcgcccctggtcactctcgttcccgccttcctctagtacgtgactgacgcgggctggctaaggcgcatagncnnnnncnnnnnnn

SEQ ID NO: 213867 - DNA, 520 bp, Homo sapiens
  misc_feature: GYAE6OF02IWZGR.13.23.C01.1.454.CMB.1.raw
  modified_base (295)..(295): a, c, t, g, unknown or other
  misc_feature (295)..(295): n is a, c, g, or t
  modified_base (360)..(360): a, c, t, g, unknown or other
  misc_feature (360)..(360): n is a, c, g, or t
  modified_base (477)..(477): a, c, t, g, unknown or other
  misc_feature (477)..(477): n is a, c, g, or t
  modified_base (510)..(520): a, c, t, g, unknown or other
  misc_feature (510)..(520): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctaacaacacaaacactcgctcttctggggtccctcatcgcttctctggctccatccttagggaacaaagctgcccttancatcgacggggccaggcagaagatgaatcagattatactgtgttcttatatggtatgcctattcngtctgtggtcggaggagccgaccggtctgaccgtccgtcggtcacgcccgaaggcctcggccccctggtccaccgtccttcgtaccccgcccttcctacgttacgtcgtcgactcgnggacggtcctggacccaaggccgtacagtagcnnnnnnnnnnn

SEQ ID NO: 213868 - DNA, 545 bp, Homo sapiens
  misc_feature: GYAE6OF02GXPM0.13.23.C01.1.454.CMB.1.raw
  modified_base (532)..(545): a, c, t, g, unknown or other
  misc_feature (532)..(545): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggcctcaggatccctgaccgattctctgcctccaagtctggcacctcagcctcctgccatcagtcggctccagtctgagatgaggctgattattactgtgcagcatactatcgaccaccctgaatggttctttggggtgttccgggacgggtacgggaccgtaagccgtacgaccggttccgtacggtcacgcccgaagggcctccgcccccgtcggtacctaccttccgtccgttccccgccctccttcttacgtaccgtcgacctggacgtccgggctggacgacggcgacagtgnnnnnnnnnnnnnn

SEQ ID NO: 213869 - DNA, 574 bp, Homo sapiens
  misc_feature: GYAE6OF02F2ZYZ.13.23.C01.1.454.CMB.1.raw
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (564)..(567): a, c, t, g, unknown or other
  misc_feature (564)..(567): n is a, c, g, or t
  modified_base (569)..(574): a, c, t, g, unknown or other
  misc_feature (569)..(574): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctggctccaagtctggcacctcagcctccctggccatcagtgggctccggtccgaggatggaggctgattattactgtgcagcagtgggatgacgagccgtgagtcgggtccggtggttcggcgggacgggaccgaagcgtcgaccggtccgtaggtcacggcccgaacggccgtccgtccccccgtccggtcctaccgttccgttccgttcccccaccccttcccgttccttacgttaccgtcgaccgttcggacggtccgggcgtcgggaccgaacgggcgaccgtagtagcgngcancgnnnncnnnnnn

SEQ ID NO: 213870 - DNA, 629 bp, Homo sapiens
  misc_feature: GYAE6OF02JWK28.13.23.C01.1.454.CMB.1.raw
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
  modified_base (626)..(629): a, c, t, g, unknown or other
  misc_feature (626)..(629): n is a, c, g, or t
tcagtcacgtactacacgaccggtgctcgatttagtacacgtgattagggattgggagtgggagttctcagactgtggtgacccaggagccatcgttctcagtgtctcctggagggacagtcacactcacttgtggcttgagatacgactcagtctctagtagttactaccccagctggtaccaacacgacccccaggccacggacctccgccgcaccgctcatctacacacaaacactcgctcttccngggtccctcatcgcttcnctgccnccntccttggaacaagctgcccttancntcgcgggccaggcaganatgaactcgtntacttatactgtctttcttaattgttggttaagtcgaccttatttntcgtcgttagttcggttgggtacggacggtcccaacccgggtcctacgggtaccccgtccgttaccgggtctaacggccccgtaagggtcccttaccgggaccccctagttcccgggttacctacccggttcccttacccggtttcccccaacccgtttcccgttacgtttaccggaccgttaccgtaccgccggttacgggcccgggttccaggtcgaccggtacgcctacggttgactgcngacnacgnnnn

SEQ ID NO: 213871 - DNA, 502 bp, Homo sapiens
  misc_feature: GYAE6OF02H5WBQ.13.23.C01.1.454.CMB.1.raw
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (492)..(502): a, c, t, g, unknown or other
  misc_feature (492)..(502): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaaccggccccaaactcctcatctatactaataatcaccggccctcagggatccctgaccgattctctgcctcaagtctggcacctcagcctcctggccatcagtcggctcccagtctgaggatgagctgatttatactgtgcagcatactatgacacctgaatggtctttgggngttcggnggagggaccaagatgaccgtctaggtcagccgaaggctcgccccgtcggtctactctcgttcccgcctccctntacgtacgtcgtactgacgcgggctggacaggcncgatgncnnnnnnnnnnn

SEQ ID NO: 213872 - DNA, 609 bp, Homo sapiens
  misc_feature: GYAE6OF02I2TH2.13.23.C01.1.454.CMB.1.raw
  modified_base (596)..(597): a, c, t, g, unknown or other
  misc_feature (596)..(597): n is a, c, g, or t
  modified_base (599)..(609): a, c, t, g, unknown or other
  misc_feature (599)..(609): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctcgcctccaagtctggcacctcagcctcctcggccatcagtcggctccagtctgaggatgaggctggtattattactgtgcagcctaatactatcgaccaccctgtaattgggttctttaggggtgtttacgggcgggtacggggtaccaaggtccgtcggtacccgtaccgtacgggtaccaccggtaccccgaacggtccttcccggacccccgtttccgggttcctacccgttccgttccggttcccccgtccccttccgttccgttacgtaccggttccgtacgttcgaacggtccgggtcgtcggtaacgacggtcgactagtaggtcnngnnnnnnnnnnn

SEQ ID NO: 213873 - DNA, 826 bp, Homo sapiens
  misc_feature: GYAE6OF02INJWT.13.23.C01.1.454.CMB.1.raw
  modified_base (789)..(789): a, c, t, g, unknown or other
  misc_feature (789)..(789): n is a, c, g, or t
  modified_base (812)..(812): a, c, t, g, unknown or other
  misc_feature (812)..(812): n is a, c, g, or t
  modified_base (820)..(820): a, c, t, g, unknown or other
  misc_feature (820)..(820): n is a, c, g, or t
tcagtcacgtactacacgaccggtgctcgattttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctccaggaaccggccccaaactcctcatctatactaataatcaccggccctcaggactccctgaccgtattctctgcctccaacgtctggccacctcacgccctcccgtcggccatcacggtccggctcccgagttcgtaggacggagtggacgggctaggtactttaactttacgttggttacgcgtagactaacgtttaactaacttacggaaccctacccgtaggttaaacgtttcggggttttaccgtttttgggggttaccgggttttaccgggggtacccggggttaaccggggtttaacccgtaaaaacggggtttccgggtaaccccggttttaacccgggttaacgggttacccggaaccgggttaacccccgggtaaacgggtcccggttacccgggttacccccccccggttacgggttaccccgttaacccgtttccccgtttccccggtttcccccggtccccctttccccggtttaacccgtttaccggttaacccggttacgtaacccgggttagggtaaccgggtccgggggtaccggttccggggaaccggtaaaccggggtccgtaaccgtacgttaacggngtacgtgcgtcacgagacgtcgngtacgtcnctagtc

SEQ ID NO: 213874 - DNA, 607 bp, Homo sapiens
  misc_feature: GYAE6OF02HTH1U.13.23.C01.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (472)..(472): a, c, t, g, unknown or other
  misc_feature (472)..(472): n is a, c, g, or t
tcagtcacgtactacacgaccggtgctcgatttagtacacgtgattagggattggggcagcttcggctgtgggtagagaagacaggactcaggacaatctccagcatggccagcttccctctcctcctcaccctcctcactcactgtgcagggtcctgggcccagtctgtgctgactcagcccaccctcagcgtctcggggacccccggnagaggtcaccgatcctcttgttctggaancagctccaacntacggaagttaattatgtatattggatcagcagcctcccaaggacccgaccccaaangcctacatctataaggaataatcagccggcctgacggggtccctgacctnttcctgtcgactccagttcncggtaccaccgtcgactccctccgacggtcctacgtcgacggtcgggtcctccgggtccgaggtactggacggtcgttagtactttattaaccgngttacgcaggtcgtagtgggactagaccgtagcgttgaacggttcggtccggttcggttccgggacgggtacgggaccgtaacggtcgtaccggtacccggttccgttaccgggcgtaccgtaccggtaacccgg

SEQ ID NO: 213875 - DNA, 669 bp, Homo sapiens
  misc_feature: GYAE6OF02FRDUJ.13.23.C01.1.454.CMB.1.raw
  modified_base (652)..(652): a, c, t, g, unknown or other
  misc_feature (652)..(652): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
  modified_base (664)..(669): a, c, t, g, unknown or other
  misc_feature (664)..(669): n is a, c, g, or t
tcagtcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacgccccaaatcctcatctatactaataatcaccggcctcaggactccctgaccgattctctcgcctccgaagttctggccacgtcacgccctcctggcccatcacgtcggcctccagtcctggaggactggaggtctagattattactgtcgacagtccaagttaactagttcgaacctacccgtgtaacgttcggttacggttttcggggtggtttccgggacggggtacgggtaacccgaaggtccgtacggtacccggttaccgttaaccgggttacgaaccggtacccgtaaaccgggtcccgttcccggtaccccccgttccgggttaccctacccgtttcccgttcccgtttacccccgtaacccttccccgttaccgttacggttaccgtcgtaccgttcggacggccgggtcgttcggaccgtacgggccgtacgtacgtagcgancgtcgngngncnnnnnn

SEQ ID NO: 213876 - DNA, 819 bp, Homo sapiens
  misc_feature: GYAE6OF02G6F4B.13.23.C01.1.454.CMB.1.raw
  modified_base (322)..(322): a, c, t, g, unknown or other
  misc_feature (322)..(322): n is a, c, g, or t
tcagtcacgtactacacgaccggtgctcgatttagtacacgtgattagggattggggctgggagaggagccccagccgtgagattcccaggagtttccgacttggtgatcagcactgaacacagaccacaaccatggagtttgggcttacttgggttttcctgttgctattttaaaggtgtccaatgtgagctgcagctggtggagtcgtgggggagtttggtacagccgagggccggtccctgacgactctcctggttataaccttctaggatttccgaacgtttgggtgtatttaatcggcttatcggtaactgggtccnccaggctaccggagggagggctgggagtggggtagtttcagtttagggagactaattctacagttggacgttaggggaaccaaacgaggtaaacgtaaccggcccggtacggtaccttaaacgggtaaaaacgggcctaagtacgtttaccaaccgttattacccgtagtaaacgacgtaagttacggtacgtaaccgaaaggtaaaccggtcgtaaacgttacccgggttaccctttttacgtacggtaccgtaacgggtacttaacggaaccgggttaacggtacccggtaagggaaacccgggtaacccgggaaacgggaacccgtaaacccgggtaaccgtacccgttaacgttacccggtttaacgttttacccggttaacggttccgggttaaccgttaaaggggtaacggttaacggttttaagttaccgggaacggtttaaccggttaaccccggttaaccggttacccggttaccggttaacccgggg

SEQ ID NO: 213877 - DNA, 736 bp, Homo sapiens
  misc_feature: GYAE6OF02JHJQ0.13.23.C01.1.454.CMB.1.raw
tcagtcacgtactacacgaccggtgctcgatttagtacacgtgattagggattggggcagcttcggctgtgggtagagaagacaggactcaggacaatctccagcatggccagcttccctctcctcctcaccctcctcactcactgtgcagggtcctgggcccagtctgtgctgactcagccaccctcagcgtctcggggacccccggcaggacgggtccaccgatcctcttgttctagaaacgcagcctacccaacgaccggaactggtagataactaaacgtggtaaccagcagcctcccgaacggaacccggacccccaaactcctacactcctaatactaaatacaccgacccgccctacgacgggactcccgtacgaccgtacttcctactcgccctacctagtccgtcggccacctcaccgtccctcccgtggaccctaactcctacggtaccggtccctccgtaccgttctagggacggtaacgtcggacggttaccttcggttaaacttttaaccgtttaacgttcggtccgtaacgtaccgtaccttaagttaaccttacgtaccgaaccctaaacccgtttagtaacgttcgggttttaccggttttcgggttccgggttacggggtaaccgggttaaaccgggtaaccgtaaaacccgtcgggttaacccggtacccgttaagggcccgtaacccggtacccggtaaccggtcccgtaccccggg

SEQ ID NO: 213878 - DNA, 739 bp, Homo sapiens
  misc_feature: GYAE6OF02IBLTH.13.23.C01.1.454.CMB.1.raw
tcagtcacgtactacacgaccggtgctcgatttagtacacgtgattagggattggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtggggggtaggtttggtacgaggcccgaggggccggtcccctggaacgactctccttgtaacttaactttcgtaggtatttcaacgttttgggagtaatttatgacctatagaacgttggggtcccacgaggcctacggagggggaaggggctagggaggttggggtagttttcagtttagggagtactaagtttcctacgatggaagttagggaaccaagaaaggtaactaccggtcccgtacggtacgttaaggtaaaaacgcgtaaggtaccttaccgaacccctaattaccgtaacgtaaaggagtacgtaggtaacgaccgaagtaaacgctaactacccggttcccttttcgagtcaaagtacgtagtaaggttacaccgttaggaaacggtaaccgacgggtaaacctagaccgacccttaagtacctttacgttaacccgtggtacgtaacgttaagggagttaaaccgttaggttcgtaccgtaaccggttacccgtaccgttaccgtcgttaaccggg

SEQ ID NO: 213879 - DNA, 272 bp, Homo sapiens
  misc_feature: GYAE6OF02HD81I.13.23.C01.1.454.CMB.1.raw
  modified_base (263)..(272): a, c, t, g, unknown or other
  misc_feature (263)..(272): n is a, c, g, or t
tcagtcacgtactacacgaccggtgctcgatttagtacacgtgattagggattggggcggaaggtatagcagtggcacgtactactttgactactggggccagggaaccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcatagnnnnnnnnnn

SEQ ID NO: 213880 - DNA, 687 bp, Homo sapiens
  misc_feature: GYAE6OF02H59S0.13.23.C01.1.454.CMB.1.raw
  modified_base (395)..(395): a, c, t, g, unknown or other
  misc_feature (395)..(395): n is a, c, g, or t
tcagtcacgtactacacgaccggtgctcgatttagtacacgtgattagggattggggctgggagaggagccccagccgtgagattcccaggagtttccacttgtgatcagcactgaacacagaccacaaccatggagtttggcttacttgggtttttccttgttgctaattttaaaaggtgtaccaatgtgagctgcagctggtggagtcgtgggggtaggtttggtacaggccgagggcggtccctgacgactctcctagtatacttcgtgtattactaacgttggtcgtattagtcgtacttatgaacgttgggtcccgccgtaggctaccgagggggaacggggtcgtagggtagttggggtagtttacaggttaggaggactaacgtttcnctagtggagtacggaaccaaacgtataacgtaccgccgtgttaacaacgtaaaggcagtactcaacctatctaacaaggtagtagtacgtacgaaccaggtaacgtcgtaacttcgttacccgtttgacgacctagattacggacgtacgaccggtaagaaccggtaaccggaacgaacccgaagaccggtccttaacgtactttacgttcggtacggtaagtaccgtaaaggtaggtaacgttaagtttccggacttaaaccgggttccctaacttccggtagtaccgggg

SEQ ID NO: 213881 - DNA, 624 bp, Homo sapiens
  misc_feature: GYAE6OF02H4I02.13.23.C01.1.454.CMB.1.raw
  modified_base (218)..(218): a, c, t, g, unknown or other
  misc_feature (218)..(218): n is a, c, g, or t
  modified_base (313)..(313): a, c, t, g, unknown or other
  misc_feature (313)..(313): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
  modified_base (613)..(613): a, c, t, g, unknown or other
  misc_feature (613)..(613): n is a, c, g, or t
  modified_base (618)..(624): a, c, t, g, unknown or other
  misc_feature (618)..(624): n is a, c, g, or t
tcagtcacgtactacacgaccggtgctcgatttagtacacgtgattagggattgggagtggattctcagactgtggtgaccccaggagccatcgttctcagtgtctcctgggagggacagtcacactcacttgtggcttgagatacggctcagtctctagtagttacctaaccccagctggtaccaaacacgaccccaggccaggctccgcgcacgcncatctaacaacaacaaacactcgcttcttcgtcggggtccctcatccgtcttctctcggctccatccgttaggaacaaacgtctcgccctttaancacgtccggacgggggccccgaggctaagaagcgtagactcgtgtattaagttactgttctttacgtttatagtgggtacgtgtactntttcgntctggttgtacgggaggacggccgacccggtnccgggtaccgtcccgttacggactaccggacccgtaacggtcctaccggccccgttaggtccgtaccgtaccttcctttccggttcccgcccgtttacctacggttacgtacgtcggttacccagggtccggtacgggtcgaggtaccgaaccgggtcgaactaggtacgggtncgcgnnnnnnn

SEQ ID NO: 213882 - DNA, 519 bp, Homo sapiens
  misc_feature: GYAE6OF02JDIYO.13.23.C01.1.454.CMB.1.raw
  modified_base (177)..(177): a, c, t, g, unknown or other
  misc_feature (177)..(177): n is a, c, g, or t
  modified_base (345)..(345): a, c, t, g, unknown or other
  misc_feature (345)..(345): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (478)..(519): a, c, t, g, unknown or other
  misc_feature (478)..(519): n is a, c, g, or t
tcagtcacgtactacacgaccggtgctcgatttagtacacgtgattagggattgggcttatcaatgccagtgggggcaccagctacaacccccgtccctcaagagccgcgtcaccatttcagtagacacgtccaagaacccagcctctccctgaacgctgagttctgtgaccgccgnagacacggccgtgtattactgtgcgcgactaggtgacgtcgtggggccaagggccacggttcacccggttctccctcacgccctaccaccgaacgggccccagttccggtcctttccccccgtaggcccgcccttgaccctccgaggcgccacctccgagcgctaacnggtcccggcccctggggcctcgacccgttggtaccaaaacgggtccttaacctttcccgtaagtaccgttgaccgtggaaccgcgggtctagggcgtacgggcgctaagtggncagctatnancgtantncannnnnnnnnnnnnnnnnnnnnnnnnnnnnnnnnnnnnnnnnn

SEQ ID NO: 213883 - DNA, 760 bp, Homo sapiens
  misc_feature: GYAE6OF02IG6PF.13.23.C01.1.454.CMB.1.raw
  modified_base (740)..(740): a, c, t, g, unknown or other
  misc_feature (740)..(740): n is a, c, g, or t
tcagtcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagacccaggccaggctccgacgcacgctcactctacaacaacaaacactcgactcgttctcgggtccctcatcgcttcctctcggctccactccgttagggaaacaaacgcgtcgtcccttatcataccggaccggggtacccgaggacgaacgaagacgtacggtaatcgtacgtaatttaacgttaacgttggttcgttttacgttttaataaggttagggttacgttcgttaccgttaactttccgtaggttccttcgggtttacgggttacggggtaacggggtacgggtacccgtacccgtaacggttcccggttaaccccggttcccggttaccggtaccgtaccgggtacccggaacgggtccgtacccggtacccccgtacgttacccgggtaccgttaaccttccggtacccccttttacccgtaaccccgttaccctttacccgttaacgggtacccggttacggtaaccgtaccgggtcgggccggtaccggtacgggtaacccggtaggttacccggaacgttaacgaccggtgtaccgtaggngcgtcgtcgtcgtctacgcg

SEQ ID NO: 213884 - DNA, 808 bp, Homo sapiens
  misc_feature: GYAE6OF02F1EWM.13.23.C01.1.454.CMB.1.raw
  modified_base (298)..(298): a, c, t, g, unknown or other
  misc_feature (298)..(298): n is a, c, g, or t
  modified_base (478)..(478): a, c, t, g, unknown or other
  misc_feature (478)..(478): n is a, c, g, or t
tcagtcacgtactacacgaccggtgctcgatttagtacacgtgattagggattggggcagcttcggctgtgggtagagaagacaggactcaggacaatctccagcatggccagccttccctctccctcctccaccctcctcactcactgtgcgagggtcctgggccctagtctgtcgctgactcacgcccaccctcgagccgtccgtaccgggggacccccgggagacggacggtccacctacttcttcgttcgttacgagtaaacgcacgcctacccaacgaccgggtaactggtanaataattaaacgtcggaccacgcacgtaccgtacccggaacggaccccgacccctaaactcctacacttaccttaataacctaactaactcccgaccgccctacggacgggtaccctcccgtacgtaaccgttcttcctccgtccggtacctaccgtagtaccgtcgtaccctacctccncccggtaccctcccgcgtccaccgtcgacgtcccgtccgtccgtacgtggacgtagtacggcggtacgtacgttagttaacgttcgttcgtcgtaacgtacgtacgtaacttacgttaacctacgtaacccgttaccgtaacggttacggtttcgggtttacccggggtttacggtttttccggggggtacggggttaacccgggaacccggggggttaaacgggtaacccgggttaacccggttccggttaaccccggttaccgggttaacccggtaccgggtaacccgggtaaacccccggggtcccgaacccgggtttaccccccgg

SEQ ID NO: 213885 - DNA, 168 bp, Homo sapiens
  misc_feature: GYAE6OF01C8ZAA.1.34.D01.1.454.CMB.1.raw
  modified_base (167)..(168): a, c, t, g, unknown or other
  misc_feature (167)..(168): n is a, c, g, or t
tcagacgagtgcgtcacgaccggtgctcgatttagatcgtctgtgttgggtttggacgttcggccagggaccaaggtggaagtcaaccgaactgtggctgcaccatctgtcttcatcttcccgccatctgaacgcactcgtctgagcgggctggcaaggcgcatagnn

SEQ ID NO: 213886 - DNA, 383 bp, Homo sapiens
  misc_feature: GYAE6OF01BQC93.1.34.D01.1.454.CMB.1.raw
  modified_base (378)..(383): a, c, t, g, unknown or other
  misc_feature (378)..(383): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtaccctagtggacgttcggcaggggaccaaggtggaagtcaacgaactgtggctgcaccatctgtcttcatcttcccgcatctgaacgcactcgtctgagcgggctggcaaggcgcatagnnnnnn

SEQ ID NO: 213887 - DNA, 386 bp, Homo sapiens
  misc_feature: GYAE6OF01DQ0R0.1.34.D01.1.454.CMB.1.raw
  modified_base (384)..(386): a, c, t, g, unknown or other
  misc_feature (384)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgcatctgaacgcactcgtctgagcgggctggcaaggcgcatagnnn

SEQ ID NO: 213888 - DNA, 491 bp, Homo sapiens
  misc_feature: GYAE6OF01BJRK7.1.34.D01.1.454.CMB.1.raw
tcagacgagtgcgtcacgaccggtgctcgatttagatcgtctgtgttgggtttggggagtcagaccctgtcgggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctgaagtattttgactaatttatactgtacaactagttattatacgtaccctagtggacgttcggaccgagggacaaggtgaagtcaacgtactgtagctgcacc

SEQ ID NO: 213889 - DNA, 387 bp, Homo sapiens
  misc_feature: GYAE6OF01CDWZD.1.34.D01.1.454.CMB.1.raw
  modified_base (376)..(376): a, c, t, g, unknown or other
  misc_feature (376)..(376): n is a, c, g, or t
  modified_base (382)..(387): a, c, t, g, unknown or other
  misc_feature (382)..(387): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctacgtggacgttcggacaggggaccaaggtgaagtcaaccgaactgtggctgcaccatctgtcttcatcttctcgccatctgaacgcactcgtctgagcgggctggcaaggcncatagnnnnnn

SEQ ID NO: 213890 - DNA, 518 bp, Homo sapiens
  misc_feature: GYAE6OF01DR5DE.1.34.D01.1.454.CMB.1.raw
  modified_base (426)..(426): a, c, t, g, unknown or other
  misc_feature (426)..(426): n is a, c, g, or t
  modified_base (513)..(518): a, c, t, g, unknown or other
  misc_feature (513)..(518): n is a, c, g, or t
tcagacgagtgcgtcacgaccggtgctcgatttagatcgtctgtgttgggtttggggaggcttgataaagcctgggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccggttcaccatctcccgagacaattcgcagaacacgttgttttgcaaatggacagcctgagagtcgcggacacggccgtctattattgtgcgacgcgctattataatataggctactggggccagggaaccctggtcaccgtctcctcagcctccaccaagggcccatccgtcttccccctggcgccctgctccaggngcacctccgagagcacagcggccctgggctgcctggtcaagggctacttccacgcactcgtctgagcgggctggcaaggcgcatagnnnnnn

SEQ ID NO: 213891 - DNA, 387 bp, Homo sapiens
  misc_feature: GYAE6OF01CGVL7.1.34.D01.1.454.CMB.1.raw
  modified_base (382)..(387): a, c, t, g, unknown or other
  misc_feature (382)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgagcggctggcaaggcgcatagnnnnnn

SEQ ID NO: 213892 - DNA, 398 bp, Homo sapiens
  misc_feature: GYAE6OF01A5ZQM.1.34.D01.1.454.CMB.1.raw
  modified_base (363)..(363): a, c, t, g, unknown or other
  misc_feature (363)..(363): n is a, c, g, or t
  modified_base (385)..(398): a, c, t, g, unknown or other
  misc_feature (385)..(398): n is a, c, g, or t
tcagacgagtgcgtcacgaccggtgctcgatttagatcgtctgtgttgggtttgggtaggtcaggccatcagcgattctttagtcctggttgcagcagaaaccagggcgagcccctccagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctacgtggacttcggccaggggaccaaggtgaagtcaacgaactgtggctgcaccatctgtcttcatctcccgccatctgaacgcatcgtctggancgggctggccaaggcgcatagnnnnnnnnnnnnnn

SEQ ID NO: 213893 - DNA, 389 bp, Homo sapiens
  misc_feature: GYAE6OF01A9715.1.34.D01.1.454.CMB.1.raw
  modified_base (382)..(389): a, c, t, g, unknown or other
  misc_feature (382)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgactgtggctgcaccatctgtcttcatcttcccgcatctgaacgcactcgtctgagcgggctggcaaggcgcatagnnnnnnnn

SEQ ID NO: 213894 - DNA, 391 bp, Homo sapiens
  misc_feature: GYAE6OF01EQW1W.1.34.D01.1.454.CMB.1.raw
  modified_base (350)..(350): a, c, t, g, unknown or other
  misc_feature (350)..(350): n is a, c, g, or t
  modified_base (379)..(379): a, c, t, g, unknown or other
  misc_feature (379)..(379): n is a, c, g, or t
  modified_base (383)..(391): a, c, t, g, unknown or other
  misc_feature (383)..(391): n is a, c, g, or t
tcagacgagtgcgtcacgaccggtgctcgatttagatcgtctgtgttgggtttgggaggtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtacaacagtattatagtacccctagtggacgttcggccaggggaccaaggtggaagtcaaccgatgtgctgcacatctgtcttcatctcccgcatctgaacncactcgtctgagcgggtctggcaaggcgnatgnnnnnnnnn

SEQ ID NO: 213895 - DNA, 488 bp, Homo sapiens
  misc_feature: GYAE6OF01D864E.1.34.D01.1.454.CMB.1.raw
  modified_base (483)..(483): a, c, t, g, unknown or other
  misc_feature (483)..(483): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagtattatagtaccctagtggacgttcggccgaggggacaggtgaagtacaaccgaactgtggntgacc

SEQ ID NO: 213896 - DNA, 399 bp, Homo sapiens
  misc_feature: GYAE6OF01AEWYP.1.34.D01.1.454.CMB.1.raw
  modified_base (389)..(399): a, c, t, g, unknown or other
  misc_feature (389)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccacctcctcacgcacctctctgcggcggcgtcggacgaaggcgacagtagnnnnnnnnnnn

SEQ ID NO: 213897 - DNA, 491 bp, Homo sapiens
  misc_feature: GYAE6OF01BVTV3.1.34.D01.1.454.CMB.1.raw
  modified_base (483)..(483): a, c, t, g, unknown or other
  misc_feature (483)..(483): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagtattatacgttaccctacgtgacgttcggccaggggaccaaggtcggaagtcaaccgactgnggctgacc

SEQ ID NO: 213898 - DNA, 497 bp, Homo sapiens
  misc_feature: GYAE6OF01DRCMY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctgaagtattttgctaattttattactgtacaactagttattatacgttacccctagtcggtacgttcggaccaggggaccaagggtggaagtcaaccgaactgtggctgacc

SEQ ID NO: 213899 - DNA, 389 bp, Homo sapiens
  misc_feature: GYAE6OF01DA6UK.1.34.D01.1.454.CMB.1.raw
  modified_base (384)..(389): a, c, t, g, unknown or other
  misc_feature (384)..(389): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccagggggaccaaggtggaagtcaaccgaactgtggctgcaccatctgtcttcatcttcccgccatctgaacgcactcgtctgagcgggctggcaaggcgcatagnnnnnn

SEQ ID NO: 213900 - DNA, 516 bp, Homo sapiens
  misc_feature: GYAE6OF01CEULM.1.34.D01.1.454.CMB.1.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagctggttgcagcagaaccagggcgagcccctnagatcgtagtctatggtgcatccagacttgcgaaggtgggtcccatccgaggttcagtggcagtgcatcgtgggactagattacactctcactatcagcagcctgcagcctagagtatttgactaatttacttactagtacaatagttaattactacgttacccctaggtcgtacggttcggccgtaaggggaccaaagggttcggaaacgtcgaaaccggactggtcggctgaccc

SEQ ID NO: 213901 - DNA, 382 bp, Homo sapiens
  misc_feature: GYAE6OF01DSM1L.1.34.D01.1.454.CMB.1.raw
  modified_base (370)..(370): a, c, t, g, unknown or other
  misc_feature (370)..(370): n is a, c, g, or t
  modified_base (376)..(382): a, c, t, g, unknown or other
  misc_feature (376)..(382): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaattttattactgtcaacagtattatagtaccctagtggacgttcggccaggggaccaaggtgaagtcaacgactgtgctgcacatctgtctcatcttccgcatctgaacgcactcgtctgagcgggctggcaaggcncatagnnnnnnn

SEQ ID NO: 213902 - DNA, 406 bp, Homo sapiens
  misc_feature: GYAE6OF01CJA9R.1.34.D01.1.454.CMB.1.raw
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
  modified_base (378)..(406): a, c, t, g, unknown or other
  misc_feature (378)..(406): n is a, c, g, or t
tcagacgagtgcgtcacgaccggtgctcgatttagatcgtctgtgttgggtttgggagtcaggccatcagcgattctttagtctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgttcaacagtattatagtaccctagtgacgttccggcaggggaccaaggtgaagtcaaccgactgtgctgcaccatctgtcttcatcttcccgcatctgaacncactcgctgagcgggctggcaaggcncatagnnnnnnnnnnnnnnnnnnnnnnnnnnnnn

SEQ ID NO: 213903 - DNA, 389 bp, Homo sapiens
  misc_feature: GYAE6OF01AVFPA.1.34.D01.1.454.CMB.1.raw
  modified_base (383)..(389): a, c, t, g, unknown or other
  misc_feature (383)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccagggggaccaaggtggaagtcaaccgaactgtggctgcaccatctgtcttcatctcccgcatctgaacgcactcgtctgagcgggctggcaaggcgcatagnnnnnnn

SEQ ID NO: 213904 - DNA, 521 bp, Homo sapiens
  misc_feature: GYAE6OF01D30FB.1.34.D01.1.454.CMB.1.raw
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
  modified_base (513)..(513): a, c, t, g, unknown or other
  misc_feature (513)..(513): n is a, c, g, or t
  modified_base (517)..(521): a, c, t, g, unknown or other
  misc_feature (517)..(521): n is a, c, g, or t
tcagacgagtgcgtcacgaccggtgctcgatttagatcgtctgtgttgggtttgggggaggcttgataaagcctggggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccggttcaccatctcccgagacaattcgcagaacacgttgttttgcaaatggacagcctgagagtcgcggacacggccgtctattattgtgcgacgcgctattataatataggctactggggccagggaaccctggtcaccgtctcctcagcctccaccaagggccccatcccgtcttcccccnggccnccctgcctccaggngcacctccgagagcacngccggccctgggctgcctggcaaggctacttccacgcactcgtctgagcgggctgggcaaggcnatgnnnnn

SEQ ID NO: 213905 - DNA, 484 bp, Homo sapiens
  misc_feature: GYAE6OF01E15OL.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtatttgctaatttattactgtacaactagtattatacgtaccctagtggacgttcggccaggggaccaggtggaagtcaacgactgtggctgc

SEQ ID NO: 213906 - DNA, 406 bp, Homo sapiens
  misc_feature: GYAE6OF01BT4XJ.1.34.D01.1.454.CMB.1.raw
  modified_base (386)..(386): a, c, t, g, unknown or other
  misc_feature (386)..(386): n is a, c, g, or t
  modified_base (392)..(406): a, c, t, g, unknown or other
  misc_feature (392)..(406): n is a, c, g, or t
tcagacgagtgcgtcacgaccggtgctcgatttagatcgtctgtgttgggtttggtagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgttacaacagtattatacgtacccctagtggacgttcggccaggggaccaaggtggaagtcaaccgaatgtggctgcaccatctgtcttcatccttccgccatctagaacgcactcgtctggagtccgggctggcaagggccncatagnnnnnnnnnnnnnnn

SEQ ID NO: 213907 - DNA, 495 bp, Homo sapiens
  misc_feature: GYAE6OF01CGFLQ.1.34.D01.1.454.CMB.1.raw
  modified_base (256)..(256): a, c, t, g, unknown or other
  misc_feature (256)..(256): n is a, c, g, or t
  modified_base (465)..(465): a, c, t, g, unknown or other
  misc_feature (465)..(465): n is a, c, g, or t
  modified_base (483)..(483): a, c, t, g, unknown or other
  misc_feature (483)..(483): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctagaagtattttagactaatttattactgtacaactagttattaatacgtaccctagtggacgttcggacgagggaccaaggtgaacgtacaaaccgaatggngctgcacatctgtcttanactctcccgtac

SEQ ID NO: 213908 - DNA, 496 bp, Homo sapiens
  misc_feature: GYAE6OF01BCFN7.1.34.D01.1.454.CMB.1.raw
tcagacgagtgcgtcacgaccggtgctcgatttagatcgtctgtgttgggtttggggagtcagacactgtcaggacacagcatggacatgagggtcccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtacaactagtattaatacgtacccctacgtggtacgttcggaccgaggggaccaagggtggaacgtcaaccgaactggtggctacg

SEQ ID NO: 213909 - DNA, 432 bp, Homo sapiens
  misc_feature: GYAE6OF01C48YX.1.34.D01.1.454.CMB.1.raw
  modified_base (234)..(234): a, c, t, g, unknown or other
  misc_feature (234)..(234): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (392)..(396): a, c, t, g, unknown or other
  misc_feature (392)..(396): n is a, c, g, or t
  modified_base (398)..(432): a, c, t, g, unknown or other
  misc_feature (398)..(432): n is a, c, g, or t
tcagacgagtgcgtcacgaccggtgctcgatttagatcgtctgtgttggggtttgggacgtcaggccatcagcggattctttagccgtggttgctagcagaaacccagggcgagcccctcagatcgtagtctatggtcgcatccagattgcaaggtggggtcccatccaggttcagtggcagtgcatctgggacagattacacgtctcactagtcagcagcctgcagcctgagnttttgcaatttattactgtcaactagtattatagtacccctagtggacgttcggccagggggacccaaggtggaacgtcaaccgactgtggactgcaccatctgtcttcatctcccgcctctcacgcactcgtctgagcgggntggcaggcncatagnnnnncnnnnnnnnnnnnnnnnnnnnnnnnnnnnnnnnnnn

SEQ ID NO: 213910 - DNA, 528 bp, Homo sapiens
  misc_feature: GYAE6OF01AIPRV.1.34.D01.1.454.CMB.1.raw
  modified_base (374)..(374): a, c, t, g, unknown or other
  misc_feature (374)..(374): n is a, c, g, or t
tcagacgagtgcgtcacgaccggtgctcgatttagatcgtctgtgttgggtttgggggtaggtcgagaccctgtcaggacacagcatggacatgagggtccccgctccagctcctcgggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgacgcccctcagatcgtagtctatggtgcatccagattgcaaggtgggtccatcaggttcagtgcagtgcatctgggacagattacacttctcactatnacgcagcctgcagcctagaacgtattttgactaagtttattactgttacaacagttattactaacgttacccccagttcggtaacgttcggtccgacgggaacccgttaaggacgggtaaacgtcgaaacccgtaacgtagtcggtgtctaccg

SEQ ID NO: 213911 - DNA, 390 bp, Homo sapiens
  misc_feature: GYAE6OF01AFYQ0.1.34.D01.1.454.CMB.1.raw
  modified_base (378)..(378): a, c, t, g, unknown or other
  misc_feature (378)..(378): n is a, c, g, or t
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgccctcctcacgcactcgtctgagcgggctggcaaggcncatagnnnnnnn

SEQ ID NO: 213912 - DNA, 383 bp, Homo sapiens
  misc_feature: GYAE6OF01B7J34.1.34.D01.1.454.CMB.1.raw
  modified_base (378)..(383): a, c, t, g, unknown or other
  misc_feature (378)..(383): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaacagtattatagtacccctagtggacgttcggccagggaccaaggtgaagtcaacgactgtgctgcaccatctgtcttcatcttcccgcatctgaacgcactcgtctgagcgggctggcaaggcgcatagnnnnnn

SEQ ID NO: 213913 - DNA, 408 bp, Homo sapiens
  misc_feature: GYAE6OF01A5C0K.1.34.D01.1.454.CMB.1.raw
  modified_base (352)..(352): a, c, t, g, unknown or other
  misc_feature (352)..(352): n is a, c, g, or t
  modified_base (389)..(408): a, c, t, g, unknown or other
  misc_feature (389)..(408): n is a, c, g, or t
tcagacgagtgcgtcacgaccggtgctcgatttagatcgtctgtgttgggtttgggagtcaggccatcagcggattctttagcctggttgcagcagaaaccagggcgagccctcagatcgtagtctatggtgcatccagattggcaaggttggggtcccatccaggttcagtggcagtgcatctgggacagattacactctcactatcagcagcctgcagcctgaagattttgctaatttattactgtcaacagtaattatagtaccctacgtggacgttcggccaggggaccaaggtgaagtcgaaccgaactgtaggctggcaccatctgtcttcatcttcccgcatctnaacgcactcgtctgagcgggctggcaaggcgcatagnnnnnnnnnnnnnnnnnnnn

SEQ ID NO: 213914 - DNA, 388 bp, Homo sapiens
  misc_feature: GYAE6OF01DDT4A.1.34.D01.1.454.CMB.1.raw
  modified_base (382)..(388): a, c, t, g, unknown or other
  misc_feature (382)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctacgtggacgttcggccaggggaccaaggtggaagtcaaccgactgtggctgcaccatctgtcttcatcttcccgcatctgaacgcactcgtctgagcgggctggcaaggcgcatagnnnnnnn

SEQ ID NO: 213915 - DNA, 510 bp, Homo sapiens
  misc_feature: GYAE6OF01BER8Y.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaccagggcgagcccctcagatcgtagtctatggtgcatccagattgcaaggtgggtccatccaggttcagtggcagtgcatctgggacagattacactctcactatcagcagcctgcagcctgaacgtatttgactaatttatactgtacaactagtattatacgtacccctagtggaacgtttcggaccgtaaggggacctaagggtacggaaaggtaccaaaccgggtaactaggtcggctggacc

SEQ ID NO: 213916 - DNA, 487 bp, Homo sapiens
  misc_feature: GYAE6OF01ETPZP.1.34.D01.1.454.CMB.1.raw
  modified_base (481)..(481): a, c, t, g, unknown or other
  misc_feature (481)..(481): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtacaactagtattatacgtaccctagtggacgttcggccaggggaccaggtgaagtcgaacgactgtggntgaccg

SEQ ID NO: 213917 - DNA, 490 bp, Homo sapiens
  misc_feature: GYAE6OF01AYRPB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgctaatttatactagtcaactagtattatacgtaccctagtcggacgttcggccaggggaccaaggtggaagtcgaacgactggtggctgacc

SEQ ID NO: 213918 - DNA, 486 bp, Homo sapiens
  misc_feature: GYAE6OF01COKUW.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctgagatcgtagtctatggtgcatccagattgcaaggtgggtcccatccaggttcagtggcagtgcatctgggacagattacactctcactatcagcagcctgcagcctgaagattttgctaatttattactgtcaacagtattatagtaccctagtggacgttcggccaggggaccaaggtggaagtcaaaccgactgtggctgacc

SEQ ID NO: 213919 - DNA, 477 bp, Homo sapiens
  misc_feature: GYAE6OF01BVOYA.1.34.D01.1.454.CMB.1.raw
  modified_base (468)..(468): a, c, t, g, unknown or other
  misc_feature (468)..(468): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtatttgctaatttattactgtcaactagtattatacgtacccctagtggacgttcggccagggaccaggtgaagtcaacgactgtgctgcaccatctgtctnatctcccgc

SEQ ID NO: 213920 - DNA, 582 bp, Homo sapiens
  misc_feature: GYAE6OF01DGX11.1.34.D01.1.454.CMB.1.raw
  modified_base (266)..(266): a, c, t, g, unknown or other
  misc_feature (266)..(266): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagctggtgcagcagaacgnggcgacgcccctcagatcgtagtctagtggtgcactccagtattgacgaagggtcgggtccagtcccgaggttcaggtggcagtgcatcgtagggacagtactacactctacactatcgagcacgcctagacacgcctagaaacgttattttagacttaatttatactacgtactaaacttagttaattaacgttaaccgttaccccgttaacggttacgggtaccggtttaccgggacccggtaaagggggaaccgtaaacggggtaacggtaaacgtaacccgaaaccgtacgttaggacggtcgaggtacccg

SEQ ID NO: 213921 - DNA, 398 bp, Homo sapiens
  misc_feature: GYAE6OF01CR2FO.1.34.D01.1.454.CMB.1.raw
  modified_base (329)..(329): a, c, t, g, unknown or other
  misc_feature (329)..(329): n is a, c, g, or t
  modified_base (385)..(398): a, c, t, g, unknown or other
  misc_feature (385)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccaatccaggttcagtggcagtgcatctgggacagattacactctcactatcagcagcctgcagcctgaagattttgctaatttattactgtcaacagtattatacgtaccctagtggacgttcggcaggggaccaaggtggaagtcaacgactgtggctgcacatctgtcttnatctcccgcatctagaacgcactcgtctgacgcggctgggacaagggcacaatagnnnnnnnnnnnnnn

SEQ ID NO: 213922 - DNA, 566 bp, Homo sapiens
  misc_feature: GYAE6OF01DO72O.1.34.D01.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgatttcttagcctggttgcagcaagaaaccgagggccgacgcccctnagatcgtagtctagtggtgcactccagtattgcgaaggggtcgggtacccatccgaggttcaggtggctagtgcagtcgtgggaacagtattaccactctcactatcagcagcctgcagcctagaagttnttttagacttaattttacttactagttacaaacttagttaacttactaaccgttacccctacggtcggtaaccgttccggggaccgtaagggggaaccgtaaggggtacggaaacgtaccgtaaaccggtaacgtaggtcggctggtaccc

SEQ ID NO: 213923 - DNA, 447 bp, Homo sapiens
  misc_feature: GYAE6OF01C46QE.1.34.D01.1.454.CMB.1.raw
  modified_base (442)..(447): a, c, t, g, unknown or other
  misc_feature (442)..(447): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtccactctacggttcgtagtggcgagtgcgactctgggacgagattactactctcactatacagacacgcctcgcgagcatagtaagtaattttgttacaatttaatttacttgtactaacaagttatttaatagtacccctaccgtggtacggttcggtccgacgggaaccgaaggtaggaagtacgaaccgaacctagtggcgtcgtcaccactctcgtcttctactcttcccgcctactctgtaacgcactccgtctgagcggggctggacgaacggcgcaatagnnnnnn

SEQ ID NO: 213924 - DNA, 500 bp, Homo sapiens
  misc_feature: GYAE6OF01COKIR.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctagaagtatttagctaatttattactgtacaactagttattataacgtaccctagtcggtacgttcggccgtaggggacctaagggtcggaagtcaacggaactgtcggctgacc

SEQ ID NO: 213925 - DNA, 513 bp, Homo sapiens
  misc_feature: GYAE6OF01DN808.1.34.D01.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcagaaaccagggcgagcccctnagatcgtagtctatggtgcatccagattgacgaagggtcgggtcccagtccgaggttcaggtggcagtgcatcgtgggacagattacactctacactatcagcagcctgcagcctagaacgtattttgacttaatttattactgtacaatagttattactacgtacccctagtcggtacgttcggaccgaggggacctaagggtgaaacgtacgaaccgtatggtcgctgac

SEQ ID NO: 213926 - DNA, 481 bp, Homo sapiens
  misc_feature: GYAE6OF01AJBGT.1.34.D01.1.454.CMB.1.raw
  modified_base (470)..(470): a, c, t, g, unknown or other
  misc_feature (470)..(470): n is a, c, g, or t
tcagacgagtgcgtcacgaccggtgctcgatttagatcgtctgtgttgggtttgggcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaattttatactgtacaactagtattatacgtaccctagtggacgttcggcagggaccaggtgaagtcaaccgactgtgctgcaccatctgtcttnatctcccaccc

SEQ ID NO: 213927 - DNA, 401 bp, Homo sapiens
  misc_feature: GYAE6OF01ETQEP.1.34.D01.1.454.CMB.1.raw
  modified_base (386)..(388): a, c, t, g, unknown or other
  misc_feature (386)..(388): n is a, c, g, or t
  modified_base (390)..(401): a, c, t, g, unknown or other
  misc_feature (390)..(401): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagttggcagtgcatctgggacagattacactctcacgtatcagcagcctggcagcctgagattttgcaatttatactgtcaacagtattatagtacccctacgtggacgttcggccagggggaccaaggtggaagtcaaccggaactgtggctgcaccatctgtcttcatcttcccgcatctgaacgcactcgtctgagcgggctggcaaggcgcatagnnnannnnnnnnnnnn

SEQ ID NO: 213928 - DNA, 491 bp, Homo sapiens
  misc_feature: GYAE6OF01A4JL6.1.34.D01.1.454.CMB.1.raw
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtggcagtgcatctgggacagattacactctcactatcagcagcctgcagcctgaagtnttttgactaatttattactgtacaactagttattatacgtacccctagtggaccgttcggccaggggaccagggtgaagtcaaccgactagtgctgacc

SEQ ID NO: 213929 - DNA, 492 bp, Homo sapiens
  misc_feature: GYAE6OF01A039S.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaatagtattatacgtacccctagtcggacgttcggccgaggggaccaaggtggaagtcaaccgactggtgctgacc

SEQ ID NO: 213930 - DNA, 555 bp, Homo sapiens
  misc_feature: GYAE6OF01CVYSS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagctggtgcagcagaaccgagggcgacgcccctcagatcgtagtctatggtgcatccagtattgacgaagggtcgggtcccagtccgaggttcagtggcagtgcatcgtagggacagtattacactctacactatcagcagcctgcagcctagaagtattttgacttaattttacttactagtacaaactagttaattactaacgttaccccttaggtacggtacggttccgggaccggtaaggggaacccgtaagggtacggaaacggttaccgaaaacccggtaacgttaggtcggccttaggacccg

SEQ ID NO: 213931 - DNA, 488 bp, Homo sapiens
  misc_feature: GYAE6OF01BJFEC.1.34.D01.1.454.CMB.1.raw
  modified_base (280)..(280): a, c, t, g, unknown or other
  misc_feature (280)..(280): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctgaagtattttgctaatttattactgtaccaactagttattatacgtaccctacgtgtacgttcggcaggggaccaaggtggaagtcaacgaactgngngtgc

SEQ ID NO: 213932 - DNA, 560 bp, Homo sapiens
  misc_feature: GYAE6OF01B4LE0.1.34.D01.1.454.CMB.1.raw
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaaggaaaccagggcgagcccctnagatcgtagtctatggtgcatccagattgcaagggtgggtcccatccaggttcagtggcagtgcatcgtgggacagattacactctcactatcagcagcctgcacgcctagaacgtnttttagactaaattttacttaactggttacaactaagttacttactaacgttaaccccgttaggttcggtaaccggttcgggaccggtaaggggaacccgtaaagggtcgggaaacgttaccgtaaaaccggtaacgttgggtacggtccgtggtaacccg

SEQ ID NO: 213933 - DNA, 388 bp, Homo sapiens
  misc_feature: GYAE6OF01AQ7KL.1.34.D01.1.454.CMB.1.raw
  modified_base (382)..(388): a, c, t, g, unknown or other
  misc_feature (382)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatctcccgcatctgaacgcactcgtctgagcgggctggcaaggcgcatagnnnnnnn

SEQ ID NO: 213934 - DNA, 520 bp, Homo sapiens
  misc_feature: GYAE6OF01A0WZM.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcaggtggcagtgcatcgtgggacagattacactctcactatcagcagcctgcagcctgaatatttgactaatttatactgtactaatagttattactacgtacccctagtcggtaccgttcggccgtaggggaacctaagggtacggaaacgtccgaaaccggtaacgttggtaggtccgtggtacccg

SEQ ID NO: 213935 - DNA, 389 bp, Homo sapiens
  misc_feature: GYAE6OF01DGDV4.1.34.D01.1.454.CMB.1.raw
  modified_base (377)..(377): a, c, t, g, unknown or other
  misc_feature (377)..(377): n is a, c, g, or t
  modified_base (383)..(389): a, c, t, g, unknown or other
  misc_feature (383)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctagtggacgttcggccaggggaccaaggtggaagtcaaccgaactgtggctgcaccatctgtcttcatcttcccaccctcctcacgcactcgtctgagcgggctggcaaggcncatagnnnnnnn

SEQ ID NO: 213936 - DNA, 391 bp, Homo sapiens
  misc_feature: GYAE6OF01DZ93U.1.34.D01.1.454.CMB.1.raw
  modified_base (377)..(377): a, c, t, g, unknown or other
  misc_feature (377)..(377): n is a, c, g, or t
  modified_base (383)..(391): a, c, t, g, unknown or other
  misc_feature (383)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgagcgggctggcaaggcncatagnnnnnnnnn

SEQ ID NO: 213937 - DNA, 386 bp, Homo sapiens
  misc_feature: GYAE6OF01BKUF7.1.34.D01.1.454.CMB.1.raw
  modified_base (379)..(386): a, c, t, g, unknown or other
  misc_feature (379)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggcaggggaccaaggtggaagtcaacgaactgtgctgcaccatctgtcttcatctcccgcatctgaacgcactcgtctgagcgggctggcaaggcgcatagnnnnnnnn

SEQ ID NO: 213938 - DNA, 487 bp, Homo sapiens
  misc_feature: GYAE6OF01B1QQB.1.34.D01.1.454.CMB.1.raw
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtggcagtgcatctgggacagattacactctcactatcagcagcctgcagcctgaagtnttttgctaatttattactgtacaactagttattatacgtacccctagtggacgttcggccaggggaccaggtggaagtcaaccgatgtggctgac

SEQ ID NO: 213939 - DNA, 388 bp, Homo sapiens
  misc_feature: GYAE6OF01BOEY1.1.34.D01.1.454.CMB.1.raw
  modified_base (312)..(312): a, c, t, g, unknown or other
  misc_feature (312)..(312): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (381)..(388): a, c, t, g, unknown or other
  misc_feature (381)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaattttattactgtcaacagtattatacgtacccctagtggacgttcggccaggggaccaaggtggaagtcaaccgatgnggctgcacatctgtctcatcctcccgcatctagaacgcactcgtcngagcggctggcaaggcncatagnnnnnnnn

SEQ ID NO: 213940 - DNA, 385 bp, Homo sapiens
  misc_feature: GYAE6OF01C8VBG.1.34.D01.1.454.CMB.1.raw
  modified_base (372)..(372): a, c, t, g, unknown or other
  misc_feature (372)..(372): n is a, c, g, or t
  modified_base (378)..(385): a, c, t, g, unknown or other
  misc_feature (378)..(385): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttatactgtcaacagtattatagtacccctagtggacttcggccaggggaccaaggtggaagtcaaccgaactgtggctgcaccatctgtcttcatcttcccacctctcacgcactcgtctgagcggctggcaaggcncatagnnnnnnnn

SEQ ID NO: 213941 - DNA, 503 bp, Homo sapiens
  misc_feature: GYAE6OF01DPOEX.1.34.D01.1.454.CMB.1.raw
  modified_base (469)..(469): a, c, t, g, unknown or other
  misc_feature (469)..(469): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagtattacactctcactatcagcagcctgccagcctagaagtattttgacttaatttattactgtacaatagttattatacgtacccctagtcggacgttcggccgaggggaccagggtgaacgtcaaccgagtgtcggntcggcacctatcctgttcttacactccttcccgc

SEQ ID NO: 213942 - DNA, 392 bp, Homo sapiens
  misc_feature: GYAE6OF01CYOAX.1.34.D01.1.454.CMB.1.raw
  modified_base (387)..(392): a, c, t, g, unknown or other
  misc_feature (387)..(392): n is a, c, g, or t
tcagacgagtgcgtcacgaccggtgctcgatttagatcgtctgtgttgggtttgggggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccagggggaccaaggtggaagtcaaccgaactgtggctgcaccatctgtcttcatcttcccgccatctgaacgcactcgtctgagcgggctggcaaggcgcatagnnnnnn

SEQ ID NO: 213943 - DNA, 495 bp, Homo sapiens
  misc_feature: GYAE6OF01DP05Y.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctcagatcgtagtctatggtgcatccagattgcaaggtgggtccatccaggttcagtggcagtgcatctgggacagattacactctcactatcagcagcctgcagcctgagattttgctaatttattactgtacaactagtattactagtaacccctagtcggacgttcggccgtaggggacgaagggtaggaagtacaaccgaactgtaggctggacc

SEQ ID NO: 213944 - DNA, 508 bp, Homo sapiens
  misc_feature: GYAE6OF01CZ7AZ.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagccccctnagatcgtagtctagtggtgcatccagattgcaagggtcgggtcccatccgaggttcaggtggcagtgcatcgtgggacagtattacactctcactatcagcagcctgcacgcctgaatattttgactaaatttattactgtacaactagttattactacgtacccctaggtggtaccgttcggaccgagggaccgaaggtcgaagtcaaaccgatggacgctgacc

SEQ ID NO: 213945 - DNA, 428 bp, Homo sapiens
  misc_feature: GYAE6OF01BUGWI.1.34.D01.1.454.CMB.1.raw
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (398)..(428): a, c, t, g, unknown or other
  misc_feature (398)..(428): n is a, c, g, or t
tcagacgagtgcgtcacgaccggtgctcgatttagatcgtctgtggtttggggtttgggagtcaggccatcagcgattctttagtcctggttgcagcagaaaccagggcgagccctcagatcgtagtctatggttggcatccaggtattgcaaggttggggttcccatccaggttcagtggcagtgcatctggggacagattacactctcactatccagcagcctgctagcctgaagattttgcaatttatactgtcaacagtattatagtacccctagtggacgttcggccagggggaccaagggtggaagtcgaaccggtaacgtgttggctgcacatctgtctcatcttccgcatctgaacgcactcgtctgancgggctggcaaggcncatagnnnnnnnnnnnnnnnnnnnnnnnnnnnnnnn

SEQ ID NO: 213946 - DNA, 496 bp, Homo sapiens
  misc_feature: GYAE6OF01BBCTC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctgaagtattttgctaatttattactgtactaactagttattatacgtacccctagtggtaccgttcggccaggggaccaagggtggaagtcaaccggactgtgcgtgaccg

SEQ ID NO: 213947 - DNA, 494 bp, Homo sapiens
  misc_feature: GYAE6OF01BVQ7K.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctnagatcgtagtctatggtgcatccagattgcaaggtgggtcccatccaggttcagtggcagtgcatctgggacagattacactctcactatcagcagcctgcagcctgaagtattttgactaatttattactgtacaactagtattatacgtaccctagtcggacgttcggccgaggggaccaaggtcggaagtcgaacgactggtggctgaccg

SEQ ID NO: 213948 - DNA, 399 bp, Homo sapiens
  misc_feature: GYAE6OF01BXAB2.1.34.D01.1.454.CMB.1.raw
  modified_base (387)..(387): a, c, t, g, unknown or other
  misc_feature (387)..(387): n is a, c, g, or t
  modified_base (393)..(399): a, c, t, g, unknown or other
  misc_feature (393)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaatttattactgtacaactagtattatacgtacccctagtggtacgttcggccgagggaccaaggtgaacgtcaaccgaatgtaggctgcaccatctgtcctcatccttcccgccctctcaccgcactcgtctgacgcgggctggcaaggcncatagnnnnnnn

SEQ ID NO: 213949 - DNA, 490 bp, Homo sapiens
  misc_feature: GYAE6OF01AZ8CO.1.34.D01.1.454.CMB.1.raw
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagtattatagtacccctagtggacgttcggccaggggaccaaggtgaagtcaaccgactagtcggntgacc

SEQ ID NO: 213950 - DNA, 527 bp, Homo sapiens
  misc_feature: GYAE6OF01AFOLN.1.34.D01.1.454.CMB.1.raw
  modified_base (280)..(280): a, c, t, g, unknown or other
  misc_feature (280)..(280): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagtattggcaagggtcgggtcccatccaggttcaggtcggcagtgcatcgtggggacagtattacacttctacactatcagcagcctgcagcctagaagtnttttgacttaattttacttactgtacaactagttaattactacgttaccctaggtcggtaccgttcggccgaggggaacctaaggggtacgtaaacgtctaaaccggtactggtcggctgacc

SEQ ID NO: 213951 - DNA, 521 bp, Homo sapiens
  misc_feature: GYAE6OF01DLGG2.1.34.D01.1.454.CMB.1.raw
tcagacgagtgcgtcacgaccggtgctcgatttagatcgtctgtgttgggtttgggggagtcagaccctgtccaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctagaagtattttgactaatttattactgtacaaactagttaattacgtaacgttacccctaggtcggtaccgttcggacccgaaggggacctaagggtacggaaagtaccgaaacgtaacgtggtcgcgtgaccg

SEQ ID NO: 213952 - DNA, 497 bp, Homo sapiens
  misc_feature: GYAE6OF01DCE8I.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcaagcagcctgcagcctgaagtattttgctaattttattactgtacaactagttattatacgtacccctagtggtacgttcggccaggggaccaagggtcgaagtcaaacgaactgtcggctgacc

SEQ ID NO: 213953 - DNA, 536 bp, Homo sapiens
  misc_feature: GYAE6OF01COA5E.1.34.D01.1.454.CMB.1.raw
  modified_base (205)..(205): a, c, t, g, unknown or other
  misc_feature (205)..(205): n is a, c, g, or t
tcagacgagtgcgtcacgaccggtgctcgatttagatcgtctgtggttaggggtttgggggagtcagaccctgtcaggacacagctatggacatgagggtccccgctcagctcctggggctcctgctgctctggctcccaggtaccaggtctgtgacattaccaattgacccagtctccatcctccctgtctgcatctattgganacagagtcaccagtcacttgccggcagtcaggccatccagcgtattctttagcctggttgcagcagaaaccagggcgacgcccctcagactcggtagtctagtggtgcatccagattgcaaaggtgggtacccatccaggttcagtggcaagtgcatctgggacagattacactctacactatcagcagcctgacagcctgaagtatttgactaatttatactgtctaatagttaattatacgtacccctaggtcggtacgttacgggaccgtaggggaacctaagggtcggaaagttacgaaaccgtaacttaggtcggctaggtacccg

SEQ ID NO: 213954 - DNA, 543 bp, Homo sapiens
  misc_feature: GYAE6OF01CAWDR.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctagtggtgcatccagattgcaaggtcgggtcccagtccaggttcagtggcagtgcatcgtgggacagacttacactctcactatcagcagcctgactagcctagaagtattttgacttaatttattactgtacaactagttattacgtacgttacccgtacgtcggaccgtttccgggccgtaaggggaaccctaaggggtacggtaaacgtaccgtaaaccggaacttagggtcggtccgtcggtaaccc

SEQ ID NO: 213955 - DNA, 487 bp, Homo sapiens
  misc_feature: GYAE6OF01BN480.1.34.D01.1.454.CMB.1.raw
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaagggtgggtcccatccaggttcagtggcagtgcatctgggacagattacactctcactatcagcagcctgcagcctagaagtatttgactaatttattactgtacaactagttattatacgtaccctagtggacgttcggccgaggggacaggtgaagtcaaaccgactgtcggntgcacatctgtcttnactctcccgc

SEQ ID NO: 213956 - DNA, 489 bp, Homo sapiens
  misc_feature: GYAE6OF01AKFPX.1.34.D01.1.454.CMB.1.raw
  modified_base (389)..(389): a, c, t, g, unknown or other
  misc_feature (389)..(389): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtccatccaggttcagtgcagtgcatctgggacagattacactctcactatcagcagcctgcagcctgaagtntttgactaatttatactgtacaactagtattatacgtaccctagtcgaccgttcggccgtaggggaccaagggtgaagtcaaccgtactagtggctgacc

SEQ ID NO: 213957 - DNA, 492 bp, Homo sapiens
  misc_feature: GYAE6OF01D3QB6.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtcaacagtattatacgtaccctacgtggacgttcggccgagggaccaaggtaggaagtacgtaaccgaactgtggctggac

SEQ ID NO: 213958 - DNA, 489 bp, Homo sapiens
  misc_feature: GYAE6OF01EZ701.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagttattatacgtaccctagtggacgttcggccaggggaccaaggtggaagtcaaccgaatgtggctgac

SEQ ID NO: 213959 - DNA, 401 bp, Homo sapiens
  misc_feature: GYAE6OF01DNKFC.1.34.D01.1.454.CMB.1.raw
  modified_base (368)..(368): a, c, t, g, unknown or other
  misc_feature (368)..(368): n is a, c, g, or t
  modified_base (394)..(401): a, c, t, g, unknown or other
  misc_feature (394)..(401): n is a, c, g, or t
tcagacgagtgcgtcacgaccggtgctcgatttagatcgtctgtggttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaaatttattactgtcaaacagttattatacgtacccctacgtggacgttcggcctaggggaccaaggtggaagtcaaccgaactgtcggctgcaccatctgtcttcatcttcccgctatctgaacgcactcgtntgagcgggactggcaaggcgcatagnnnnnnnn

SEQ ID NO: 213960 - DNA, 486 bp, Homo sapiens
  misc_feature: GYAE6OF01CFW3B.1.34.D01.1.454.CMB.1.raw
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctgaagattttgctaatttattactgtcaaacagtaattatagtacccctagtggacgttcggccaggggacaagggtgaagtcaacgaactgtcggntgac

SEQ ID NO: 213961 - DNA, 494 bp, Homo sapiens
  misc_feature: GYAE6OF01CL2GC.1.34.D01.1.454.CMB.1.raw
  modified_base (488)..(488): a, c, t, g, unknown or other
  misc_feature (488)..(488): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattctttagcctggttgcagcaagaaaccgagggcgacgcccctcagatcgtagtctatggtgcatccagattgcaaggtgggtcccatccgagttcagtggcagtgcatcgtgggacagattacactctcactatcagcagcctgcagcctagaagtatttgactaatttattactagtacaactagttattatacgtaccctagtgtacgttcggccgagggacaaggtggaagtacaacgtaatggngctgac

SEQ ID NO: 213962 - DNA, 510 bp, Homo sapiens
  misc_feature: GYAE6OF01CXVTQ.1.34.D01.1.454.CMB.1.raw
  modified_base (268)..(268): a, c, t, g, unknown or other
  misc_feature (268)..(268): n is a, c, g, or t
  modified_base (505)..(505): a, c, t, g, unknown or other
  misc_feature (505)..(505): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctcagatcgtagtctatggtgcatccagatttggcgaaggttcgggtcccagtcccaggttcaggttggctagtgcagtcgtggggacagacttacacctctacactatcagcagcctgcagcctagaagtattttgacttaatttattactgtacaactagttaattatacgttaccctagtcggtacgttcggccgaggggacagggtgaagtcaaccgatgcgntgacc

SEQ ID NO: 213963 - DNA, 503 bp, Homo sapiens
  misc_feature: GYAE6OF01BQ1D8.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtacatccagattgcaaggtggggtcccatccaggttcagtggcagtgcatctgggacagattacactctcactatcagcagcctgcagcctgaagtattttgactaattttatactgtactaatagttattatacgtacccctagtcggacgttcggaccgaggggaccaagggtcggaagtcgaaaccgtactggtgctgctacc

SEQ ID NO: 213964 - DNA, 511 bp, Homo sapiens
  misc_feature: GYAE6OF01EVHEO.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaatattttgctaatttattactgtacaactagttattatacgtaccctacgtcggaacgtttcgggaccgaggggacccaagggttggaaacgtaccgaaaccggtactggtcgcgtgaccg

SEQ ID NO: 213965 - DNA, 393 bp, Homo sapiens
  misc_feature: GYAE6OF01CISSG.1.34.D01.1.454.CMB.1.raw
  modified_base (384)..(393): a, c, t, g, unknown or other
  misc_feature (384)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatacgtacccctagtggacgttcggccaggggaccaaggtggaagtcaaccgaactgtggctgcaccatctgtctcatctcccgcatctgaacgcactcgtctgacgcgggctggcaaggcgcatagnnnnnnnnnn

SEQ ID NO: 213966 - DNA, 552 bp, Homo sapiens
  misc_feature: GYAE6OF01CKKEE.1.34.D01.1.454.CMB.1.raw
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaaggtgggtcccatccaggttcagtggcagtncatcgtgggacagattacactctacactatcagcagcctgcagcctagaagtattttgacttaatttattactgtactaacgtagttattactacgttaccctacggttcggtaaccggtttccgggacccgtaaggggggtaaccctaaaggggttacggtaaacggtaccgtaaaccggtaacgttgggtacgggtctgggtaacccc

SEQ ID NO: 213967 - DNA, 488 bp, Homo sapiens
  misc_feature: GYAE6OF01BX398.1.34.D01.1.454.CMB.1.raw
  modified_base (466)..(466): a, c, t, g, unknown or other
  misc_feature (466)..(466): n is a, c, g, or t
  modified_base (475)..(476): a, c, t, g, unknown or other
  misc_feature (475)..(476): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtatttgactaatttattactgtacaactagttattatacgtacccctagtcggacgttcggccgagggacaaggtgaagtcaacgactgtgctgcacntctgtcttnntcctcccgtccc

SEQ ID NO: 213968 - DNA, 174 bp, Homo sapiens
  misc_feature: GYAE6OF01DXEIQ.1.34.D01.1.454.CMB.1.raw
tcagacgagtgcgtcacgaccggtgctcgatttagatcgtctgtgttgggtttgggggaagaggaagactgacggtcctgctccaggagcacctccgagagcacagcggccctgggctgcctggtcaaggactacttccacgcactcgtctgagcgggctggcaaggcgcatag

SEQ ID NO: 213969 - DNA, 548 bp, Homo sapiens
  misc_feature: GYAE6OF01CANGJ.1.34.D01.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtncatccagattgcaaggtgggtccatccaggttcagtggcagtgcatctgggacagattacactctcactatcagcagcctgcagcctagaacgtattttgacttaaattttacttaactgtacaactagttaattagtaacgttaccccgtacgtcgggtaaccgtttccggaccggaacgggggtaacccgaaagggtacgggtaaacgtaccgaaaaccgtaacgttggtacggtcgtggtaacccg

SEQ ID NO: 213970 - DNA, 492 bp, Homo sapiens
  misc_feature: GYAE6OF01BTH6S.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggtcccatccaggttcagtggcagtgcatcgtgggacagattacactctcactatcagcagcctgcagcctgaagtattttgactaatttattactgtacaactagttattatacgtaccctagtcggacgttcggccaggggaccaaggtgaagtcaaccgactgtcggctgacc

SEQ ID NO: 213971 - DNA, 497 bp, Homo sapiens
  misc_feature: GYAE6OF01D7U8E.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagctgcagcctagaagtatttgactaatttatactgtacaactagttattatacgtacccctagtggaccgttcggccgaaggggaccaagggtgaagtacgaaccgaacgtgtcggctgacc

SEQ ID NO: 213972 - DNA, 397 bp, Homo sapiens
  misc_feature: GYAE6OF01EH8J0.1.34.D01.1.454.CMB.1.raw
  modified_base (391)..(397): a, c, t, g, unknown or other
  misc_feature (391)..(397): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagactgcagcctgaagattttgctaattttattactgtcaacagtattatagtacccctagtggacgttcggccaggggaccaaggtggaagtcaaccgaactgtggctgcaccatctgtcttcatccttcccgccatcctgaacgcactcgtctgagcgggctgggcaaagggcgcatagnnnnnnn

SEQ ID NO: 213973 - DNA, 517 bp, Homo sapiens
  misc_feature: GYAE6OF01AWSK2.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctagtggtgcatccagattgacaagggtgggtcccatccaggttcagtggcagtgcatcgtgggacagattacactctcactatcagcagcctgcagcctagaagtatttgacttaatttatactgtacaactagtattactacgtaccctaggtcggtaccgttcggaccgaggggtacctaagggtacggaaacgtaccgaaaccgtacgtggtacggctgacc

SEQ ID NO: 213974 - DNA, 548 bp, Homo sapiens
  misc_feature: GYAE6OF01CZQVM.1.34.D01.1.454.CMB.1.raw
  modified_base (223)..(223): a, c, t, g, unknown or other
  misc_feature (223)..(223): n is a, c, g, or t
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
  modified_base (417)..(417): a, c, t, g, unknown or other
  misc_feature (417)..(417): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggngagtcaggccatcagcgatttctttagccttggttgcagcaagaaaccgagggcacgccccctnaagatcgtagtctagtggtgcatccagattgcgtaagggtcgggtcccatccgaggttcaggtcggcagtncatcgtagggacagtacttacactctcactatccagcagccctgacagcctagaacttntttagacttaatttatactagtacaaatgttaattacgacgttaccctaggtcggtaccgttccggacgaagggggtacctaaggggtacggaaacgtacccgaaaccgtacgttggtcggccttggaccc

SEQ ID NO: 213975 - DNA, 391 bp, Homo sapiens
  misc_feature: GYAE6OF01AQEFO.1.34.D01.1.454.CMB.1.raw
  modified_base (381)..(381): a, c, t, g, unknown or other
  misc_feature (381)..(381): n is a, c, g, or t
  modified_base (387)..(391): a, c, t, g, unknown or other
  misc_feature (387)..(391): n is a, c, g, or t
tcagacgagtgcgtcacgaccggtgctcgatttagatcgtctgtgttgggtttgggagtcaggccatcagcgattcctttagcctggttgcagcagaaaccagggcggagcccctcagactcggtagtctatggtgcatccagattgcaaggtggggtcccatccgaggttcagtggcagtgcatctgggacagattacactctcactatcagcagcctgcagcctgaagattttgctaatttatactgtcaacagtattatagtacccctagtggacgttcggccaggggaccaaggtggaagtcaaccgaactgtgctgcaccatctgtcttcatcttcccgcatctgaacgcactcgtctgagcgggctggcaaggcncatagnnnnn

SEQ ID NO: 213976 - DNA, 492 bp, Homo sapiens
  misc_feature: GYAE6OF01EC1KI.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtactaactagtattatacgtacccctacgtggtacgttcggccgaggggacaaggtgaagtacaacgaactgtggctgac

SEQ ID NO: 213977 - DNA, 389 bp, Homo sapiens
  misc_feature: GYAE6OF01CU423.1.34.D01.1.454.CMB.1.raw
  modified_base (383)..(389): a, c, t, g, unknown or other
  misc_feature (383)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgactgtggctgcaccatctgtcttcatcttcccgccatctgaacgcactcgtctgagcgggctggcaaggcgcatagnnnnnnn

SEQ ID NO: 213978 - DNA, 544 bp, Homo sapiens
  misc_feature: GYAE6OF01C1LCN.1.34.D01.1.454.CMB.1.raw
  modified_base (222)..(222): a, c, t, g, unknown or other
  misc_feature (222)..(222): n is a, c, g, or t
  modified_base (283)..(283): a, c, t, g, unknown or other
  misc_feature (283)..(283): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgtattctttagcctggttgcagcaagaaccgagggcacgcccctnagatcgtagtctagtggtgcatccagattggacgtaaggggtcgggtcccagtccgaggttcaggtggcagtgctatcgtagggacagacttacactctcactatcagcagcctgcagcctagaagtnttttgacttaatttattactatacaactagttaacttactacgtaccctaggtacggtaccgttccgggaccgaaggggaacccgtaagggtacggaaacgtaccgaaaccgtacgtaggtcggcgtcggacc

SEQ ID NO: 213979 - DNA, 494 bp, Homo sapiens
  misc_feature: GYAE6OF01A33WY.1.34.D01.1.454.CMB.1.raw
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtcaactagttattatacgtacccctagtcggacgttcggccaggggaccaagggtgaagtcaaacgactagnggcgtgacc

SEQ ID NO: 213980 - DNA, 511 bp, Homo sapiens
  misc_feature: GYAE6OF01AT3LB.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggtccatccaggttcagtgcagtgcatctgggacagattacactctcactatcagcagcctgcacgcctagaagtattttgactaatttattactgtacaactagttattatacgtacccttagtcggtacgttcggaccgtaggggtaccaagggtaggaaacgtacgaaacccgaagtaggtcggcgtgtacc

SEQ ID NO: 213981 - DNA, 494 bp, Homo sapiens
  misc_feature: GYAE6OF01BYVFO.1.34.D01.1.454.CMB.1.raw
  modified_base (255)..(255): a, c, t, g, unknown or other
  misc_feature (255)..(255): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggtgcagcagaaaccagggcgacgcccctnagatcgtagtctatggtgcatccagattgcgaagggtgggtcccatccaggttcagtggcagtgcatcgtgggacagtattacactctacactatcagcagcctagcacgacctgaagttattttgacttaatttattactgtacaactgttaattatacgtaccctagtgacgttcgaccgagggaccaggtcgaagtcgaacctagtgtgcncgcacntctgtctacnctctcccgc

SEQ ID NO: 213982 - DNA, 505 bp, Homo sapiens
  misc_feature: GYAE6OF01D1DYZ.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatctgggacagattacactctcactatcagcagctgcagcctgaatatttgctaatttatactgtacaactagttattatacgtaccctacgtcggtacgttcggaccgaggggacccgtaagggtagtaagtaccgtaacggaactggtaggctgtaccg

SEQ ID NO: 213983 - DNA, 502 bp, Homo sapiens
  misc_feature: GYAE6OF01CTRL2.1.34.D01.1.454.CMB.1.raw
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (354)..(354): a, c, t, g, unknown or other
  misc_feature (354)..(354): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcaggccatcagcgattctttagtctggttgcagcagaaaccngggcacgcccctnagatcgtagtctagtggtgcatccagtattgacaaggtgtggtcccatccaggttcagtggcagtgcatcgngggacagattacactctacactatcagcagcctgcagcctagaagtatttagacttaatttacttactagtacaactagtattatacgtaccctagtggtacgtcggacgagggacgaaggtcgacgtaccaacgactggngngtacg

SEQ ID NO: 213984 - DNA, 587 bp, Homo sapiens
  misc_feature: GYAE6OF01CT7QZ.1.34.D01.1.454.CMB.1.raw
  modified_base (222)..(222): a, c, t, g, unknown or other
  misc_feature (222)..(222): n is a, c, g, or t
  modified_base (288)..(288): a, c, t, g, unknown or other
  misc_feature (288)..(288): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgtatttctttagccttggttgcagacaagaaaccgagggcgacgcccctnagatcgtagtctagtggtgcatccagtagttggacgaagggtcgggtccccagtccgaggttcaggtggcagtgctagtcgtagggacagattacactcctacactatcagcagcctgcacgacctagtaacgttntttacgactttaattttacttactagtacctaagttagttattaacgttacgtaacccgttacggtacgggtacggttccgggacggtaacggggtaaccgtaaggggtacgggaaacgttacccgaaaccggtacggttaggtcgggtaccgtcggtaaccc

SEQ ID NO: 213985 - DNA, 542 bp, Homo sapiens
  misc_feature: GYAE6OF01CE300.1.34.D01.1.454.CMB.1.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (437)..(437): a, c, t, g, unknown or other
  misc_feature (437)..(437): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggcgagtcaggccatcagcgtattcttagccttggtgcagcaagaaccgngggcacgcccctnagatcgtagtctagtggtgcatccagattgacgtaagggtcgggtacccatccgaggttcaggtggacagtgcagtcgtagggacagtacttacactcctacactatcagcagccctgcagtcctagtaatatttagacttaatttactactntacaactagttaattactaaccgtacccttaggtacggtaccgttcggaccggaggggaccaagggtcggaaacgttaccgaaaccgagtggtcgcgtgtacccg

SEQ ID NO: 213986 - DNA, 595 bp, Homo sapiens
  misc_feature: GYAE6OF01DLZD0.1.34.D01.1.454.CMB.1.raw
  modified_base (591)..(595): a, c, t, g, unknown or other
  misc_feature (591)..(595): n is a, c, g, or t
tcagacgagtgcgtcacgaccggtgctcgatttagatcgtctgtgttgggtttgggggaggcttgataaagcctggggggtccctgagactctcctgtggagcctctggattcaccttttggaacctacgccatgagctgggtccgccaggctccagggaaggggctggagtgggtctccgctattagtggtagtggcggtagcacatactacgcagactccgtgaagggccgttcaccatctcccgagacaattcgcagaacacgtttgtttttgcaaatggacagcctgagagtcgcggacacggccgtctattattgtgcgacgcgctattataatataggctactggggccagggaaccctggtcaccgtctcctcacgccctaccaccaacgggccccagtccggtccttccccccgtggcccgccctcgcctccgaggacgccaccctccgagacgccacgacgccggcccgtgggcctcggccgtgggtaccaacgggtaccttaccgttcccaaccgcctaaccgttccgtcgtcggacggccggggtccgtagggaccgaaagggccgacgaacgtaggacnnnnn

SEQ ID NO: 213987 - DNA, 531 bp, Homo sapiens
  misc_feature: GYAE6OF01BBKU8.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaattttattactgtactaactagttaattactacgttacccctaggtcggtaaccgtttcggccgagggggacccgtaaagggttacgggaaagttaccgaaaccgtaaactggtacgggcgtggtaccc

SEQ ID NO: 213988 - DNA, 393 bp, Homo sapiens
  misc_feature: GYAE6OF01BFRE8.1.34.D01.1.454.CMB.1.raw
  modified_base (386)..(393): a, c, t, g, unknown or other
  misc_feature (386)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattatagtacccctagtggacgttcggccaggggaccaaggtggaagtcaaccgaactgtggctgcaccatctgtcttcatcttcccgcatctgaacgcactcgtctgagcgggctggcaaggcgacatagnnnnnnnn

SEQ ID NO: 213989 - DNA, 399 bp, Homo sapiens
  misc_feature: GYAE6OF01CSSIJ.1.34.D01.1.454.CMB.1.raw
  modified_base (380)..(399): a, c, t, g, unknown or other
  misc_feature (380)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagatttgcaatttattactgtcaacagtattatagtaccctagtggacgttcggccaggggaccaaggtggaagtcaaccgaactgtggctgcacatctgtcttcatttcccgcatctgaacgcactcgtctgagcgggctggctaaggcgcatagnnnnnnnnnnnnnnnnnnnn

SEQ ID NO: 213990 - DNA, 639 bp, Homo sapiens
  misc_feature: GYAE6OF01DQNVC.1.34.D01.1.454.CMB.1.raw
  modified_base (102)..(102): a, c, t, g, unknown or other
  misc_feature (102)..(102): n is a, c, g, or t
  modified_base (122)..(122): a, c, t, g, unknown or other
  misc_feature (122)..(122): n is a, c, g, or t
  modified_base (429)..(429): a, c, t, g, unknown or other
  misc_feature (429)..(429): n is a, c, g, or t
tcagacgagtgcgtcacgaccggtgctcgatttagatcgtctgtgttgggtttgggggagtcagaccctgtcaggacacagcatggacatgagggtccccgntcagctcctggggacctcgntgcgtctggtcgtccacggtacgacgctgtgacatctaacttagtacccacgtctccactcctcccttcgtcttcgcactcttattggtaggacagagtacaccaactctacttcgtccgggccggagtcgacggaccactacacgacgatttcttttacgtccgtcggtttggtcacgacgacgaaaaccgaacgggcgggacgaccccgtccaggaatcgtaggtctataggtggcataccagattgcgaaggtagggggtcccgactcgtacgggttcgagtaggcgagtgcatacgtcggganaacgtgttaactacctcttacactaactcagacacgcccttgcgacgcctgaaggtattttcgtactaattttaatttactagtaccaacaaggtttatttactacgtaaccccgtaccgtgggtaccggttcgggtcccgaacggggaaccggtaaggttagggaaacgttcccaaaccgtaacttaggttgggactcgtccgaaaccc

SEQ ID NO: 213991 - DNA, 700 bp, Homo sapiens
  misc_feature: GYAE6OF01B2U8H.1.34.D01.1.454.CMB.1.raw
  modified_base (198)..(198): a, c, t, g, unknown or other
  misc_feature (198)..(198): n is a, c, g, or t
  modified_base (694)..(694): a, c, t, g, unknown or other
  misc_feature (694)..(694): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctagctatctagtgganacagtacgtaccactatctacgttcgggccgggacgacgtacgacggacctatacgacggacgttacttttacgtttacgtccggtttgggttcgacgacgaccgaaaccggaaaccggacggggaccgacccgtccccctagaacgtacgttacggttacgttacgtaggtggcgactactccgaagtagttcggaacggtaagggggttccggtaccctaacgtccggttacggttacgtagggtcggacgtaggtcgactagtcggtagggactagttacttaccgtaccttactactaacttactacgacgacgaccgtccgtagaccgtaccgtccgtaaggtaacgtttattttcgaactttaagttttacttacgtacgttaacaacgttatttaacttacgttaacccgttacccgtaggtccggtaccggttccggacggtaacgggacgtagggtacgtaacgtaccgaacgtacgtaggtcggtntcgacc

SEQ ID NO: 213992 - DNA, 774 bp, Homo sapiens
  misc_feature: GYAE6OF01CMW2A.1.34.D01.1.454.CMB.1.raw
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
tcagacgagtgcgtcacgaccggtgctcgatttagatcgtctgtgttggggtttggggacgtccagaccctggtcgaggacacacgcatgggacatcgagggtcccgctacagctcgtggggcgtccctgctggctcgtcggtcgtcccacggtaccacgctcgtgacactccaattcgacccgagtcctccatcctcctgtcgttgcagtctagttcggagacagacgtacgaacgatcgaacttcgcggtcgaagtcacggcctatcaagcgtagtttccttagtccgtaggttcgctacgcaaggaaacgagggacgacgacccctanagtactcgtagtacctagtcggngcaatccagttactgaacgtaaggtcgggtacctagtccgaacggttccgacggtcggacgtaacggtcggtcgttaaacgttcgttaggggaactaacggtaacgttaaccgaaccgttccttaactaaacgtttaagttaccgtttaagggaccgttaaggttacccgttacggaaccctaaccggtaccgttaagggtaaacggttacggggttttacaaccgtttaaacggttttacggttaaccgtagggttaacctaaacggttaggttaaccttacgtaaccgttaccccgttaacgggtccggtaacccggttaccgggaaccgggtaaccggggtaaccttaacggggttaccggtaaacccgttaccggtaaaaccccggtaacgttacggtacggaacgtcggaacccg

SEQ ID NO: 213993 - DNA, 427 bp, Homo sapiens
  misc_feature: GYAE6OF01DR3WI.1.34.D01.1.454.CMB.1.raw
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (417)..(427): a, c, t, g, unknown or other
  misc_feature (417)..(427): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaaattttataactgtacaaactagttaattatacgtacccccttagtcggtacgttcggaccaggggaccaaggtggaacgtcaaccgactgngctgcacatctgtcttcactcttcccgctatctagaaccncacctcgtctcggaggccgggtctgggacctaagggccgacaagtacgnnnnnnnnnnn

SEQ ID NO: 213994 - DNA, 499 bp, Homo sapiens
  misc_feature: GYAE6OF01CJ5B1.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (494)..(494): a, c, t, g, unknown or other
  misc_feature (494)..(494): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgagcccctnagatcgtagtctatggtgcatccagattgcaagggtcgggtcccagtccgaggttcagtggcagtgcatcgtgggacagattacactctcactatcagcagcctgcagcctagaagtattttgacttaatttattactgtactaactagttattatacgtaccctagtcggtacgttcggccgtagggactagggtcgaagtcaacgactgcgntgacc

SEQ ID NO: 213995 - DNA, 389 bp, Homo sapiens
  misc_feature: GYAE6OF01BGI35.1.34.D01.1.454.CMB.1.raw
  modified_base (378)..(378): a, c, t, g, unknown or other
  misc_feature (378)..(378): n is a, c, g, or t
  modified_base (384)..(389): a, c, t, g, unknown or other
  misc_feature (384)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctacgtggacgttcggccaggggaccaaggtggaagtacaaccgaactgtggctgcaccatctgtcttcatcttcccgcatctgaacgcactcgtctgagcggctggccaaggcncatagnnnnnn

SEQ ID NO: 213996 - DNA, 517 bp, Homo sapiens
  misc_feature: GYAE6OF01EDTUH.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgacgggcgagtcaggccatcagcgattctttagcctggttgcagcagaaaccagggcgagcccctcagatcgtagtctatggtgcatccagattgcaaggtgggtccatccaggttcagtgcagtgcatcgtgggacagattacactctcactatcagcagcctgcagcctagaagtattttgactaatttattactagtactaactagttattactacgtacccctagtggtaaccgttcgggaccgtaaggggaccaagggtacggaagtaccgtaaaccggaacgtgtcggcgtgaccg

SEQ ID NO: 213997 - DNA, 492 bp, Homo sapiens
  misc_feature: GYAE6OF01EWO7T.1.34.D01.1.454.CMB.1.raw
  modified_base (487)..(487): a, c, t, g, unknown or other
  misc_feature (487)..(487): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctgaagtattttgctaattttatactgtacaactagttattatacgtaccctagtcggacgttcggccgaggggacaaggtggaacgtcgaaccgaactgtggntgacc

SEQ ID NO: 213998 - DNA, 501 bp, Homo sapiens
  misc_feature: GYAE6OF01EJJFZ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtattttgactaattttattactgtactaactagttattatacgtacccctagtcggtacgttcggccgaggggaccgaagggtgaagtacaacgaactgtggctgacc

SEQ ID NO: 213999 - DNA, 769 bp, Homo sapiens
  misc_feature: GYAE6OF01D3W3Q.1.34.D01.1.454.CMB.1.raw
  modified_base (265)..(265): a, c, t, g, unknown or other
  misc_feature (265)..(265): n is a, c, g, or t
tcagacgagtgcgtcacgaccggtgctcgatttagatcgtctgtgttgggtttgggggcatggacatgagggtcccgctcagctcctgggctcctgctgctctcggctcccaggtaccacgctcgtgacatccaaagttgacccagtctccgactcctccctgtctgcatctattggagacacgagtcaccatcacgttgccgggcgagtcaggccatcagcgattcgtttagcctggttgcagcagaaaccagggcagcccctnagatcgtagtctataggtgcactccgaagacttagacctaaagggttcggggtacccagttccgtaacgggttccaacggttcggacctaaggttcgactacgttccgtacggggaacctaacggtaactttaccgaaccttcctaccaaccgttacttaccgaaagtccaacggtacccgttacggtaccgaccggtaccccgttaaggtaaacggttaacgtttttacggaaccgtttaaacgttttttaactttaaccgttacgttaacctaaaccgttaacgtttaaactttaacggttaacccgtttaacccccgttaacgggtttaccgggttaacccgggtttaccgggaacccggtaacgggggtaacccgtaacggggttaacgggaaaccgttaccgaaacccggtacgttcggggtacgggtaccgtacggacccgtaacccgtagtacccgttcggttaccctttacgaaccttcccgttccccggtaaccc

SEQ ID NO: 214000 - DNA, 565 bp, Homo sapiens
  misc_feature: GYAE6OF01B67WH.1.34.D01.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccggngagtcaggccatcagcgtattcttagcctggtgcagcaagaaccagggcgacgcccctnagatcgtagtctagtggtgcatccagattgacgtaagggtcgggtccagtcccgaggttcagtggctagtcgcagtcgtagggacagtattaccacttctacactatcagcagcctgcagtcctagaacgttatttagacttaattttactacgtagtacaaacgttattattactaccgttaacccttaggtacggtaacgttccggaccgtaaggggaaccctaagggtacggtaaacggtacccgtaaaccggtaacttgggtacggtcgtcggtaacccg

SEQ ID NO: 214001 - DNA, 583 bp, Homo sapiens
  misc_feature: GYAE6OF01BF3JZ.1.34.D01.1.454.CMB.1.raw
  modified_base (284)..(284): a, c, t, g, unknown or other
  misc_feature (284)..(284): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
tcagacgagtgcgtcacgaccggtgctcgatttagatcgtctgtgttgggtttaagggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagcctggttgcagcaagaaaccgagggccgacgcccctnagatcgtagtctagtggtgcatccagtattggacgtaaggggtcgggtaccccagttcccgaggttcaggtcggcagtcgcagtcgtagggacagtacttacacttctcaacttancagcagcctagcngtccgtagtaattatttgacttaattttacttactgtaactaagtagttaatttacgtaaccgttaccccgttaaggttcggtaaccggtttcgggacccgtaaggggtaccgtaaagggttcggaaacgtaccggtaaaccgtaacgtcggttacggcgtcgtaacccg

SEQ ID NO: 214002 - DNA, 485 bp, Homo sapiens
  misc_feature: GYAE6OF01EWF4E.1.34.D01.1.454.CMB.1.raw
  modified_base (281)..(281): a, c, t, g, unknown or other
  misc_feature (281)..(281): n is a, c, g, or t
  modified_base (391)..(391): a, c, t, g, unknown or other
  misc_feature (391)..(391): n is a, c, g, or t
  modified_base (478)..(478): a, c, t, g, unknown or other
  misc_feature (478)..(478): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtccatccaggttcagtggcagtgcatctgggacagattacactctcactatcagcagcctgcagcctgaatntttgctaatttatactgtacaactagtattatacgtaccctagtggacgttcggcgtaggggacaaggtgaagtacaaaccgatggngctgacc

SEQ ID NO: 214003 - DNA, 387 bp, Homo sapiens
  misc_feature: GYAE6OF01D2YGS.1.34.D01.1.454.CMB.1.raw
  modified_base (339)..(339): a, c, t, g, unknown or other
  misc_feature (339)..(339): n is a, c, g, or t
  modified_base (382)..(387): a, c, t, g, unknown or other
  misc_feature (382)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgaactgtggctgcacatctgtcttcatcttcccgntctcctcacgcactcgtctgagcgggctggcaaggcgcatagnnnnnn

SEQ ID NO: 214004 - DNA, 502 bp, Homo sapiens
  misc_feature: GYAE6OF01EPIE1.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccagtccaggttcagtggcagtgcatctgggacagattacactctcactatcagcagcctgcagcctagaagtattttgactaatttattactgtacaactagttattatacgtacccctaggtggtacgttcggccgaggggaccaagggtggaagtacgaaccgactggtggctgaccg

SEQ ID NO: 214005 - DNA, 527 bp, Homo sapiens
  misc_feature: GYAE6OF01AGUSE.1.34.D01.1.454.CMB.1.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcagaaaccagggcagcccctnagatcgtagtctatggtgcactccagattgcgaaggtcgggtcccatccaggttcagtggcagtncatctgggacagacttacactctcactatcagcagcctgcagctagtagtatttgacttaatttatactgtactaactattaattactacgtaccctaggtacggtacgttacggccgtaaggggtaacctaagggtacggaaacgttacccgtaaaccggaacgttggtacggcgttgaccc

SEQ ID NO: 214006 - DNA, 483 bp, Homo sapiens
  misc_feature: GYAE6OF01A56JS.1.34.D01.1.454.CMB.1.raw
  modified_base (369)..(369): a, c, t, g, unknown or other
  misc_feature (369)..(369): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (473)..(474): a, c, t, g, unknown or other
  misc_feature (473)..(474): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtntttgactaatttatactgtacaactagtattatacgtaccctagtggacgttcggccgaggggaccaaggtggaagtcaaccgatgtgctgcacntctntcttnntcctccgac

SEQ ID NO: 214007 - DNA, 581 bp, Homo sapiens
  misc_feature: GYAE6OF01BBZ6X.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccgagggcgacgcccctcagactcgtagtctagtggtgcatccagtattgacgaagggtcgggtcccatccgaggttcaggtggcagtgcatcgtgggacagtattacactctacactatcagcagcctgccagcctagaagttattttgacttaattttacttactgtacctaaacgtagttaattacgtaaccgttaccccgttacgggttacgggtaacccggtttaccgggacccggtaagggggaacccgtaaaggggtacgggtaaacgttacccgaaacccggtaacgttggtcggtcgtcggtaccc

SEQ ID NO: 214008 - DNA, 496 bp, Homo sapiens
  misc_feature: GYAE6OF01DOTPG.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcacgcctgcagcctgtaagtattttgctaatttatactgtacaactagttattatacgtacccctagtcggtacgttcggcgaggggaccaagggtgaagtacgaacgactgtcggctgac

SEQ ID NO: 214009 - DNA, 389 bp, Homo sapiens
  misc_feature: GYAE6OF01AFSZD.1.34.D01.1.454.CMB.1.raw
  modified_base (386)..(389): a, c, t, g, unknown or other
  misc_feature (386)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggtaccaaggtggaagtcaaccgaactgtggctgcaccatctgtcttcatcttcccgccatctgaacgcactcgtctgagcgggctggcaaggcgcatagnnnn

SEQ ID NO: 214010 - DNA, 503 bp, Homo sapiens
  misc_feature: GYAE6OF01EHVXT.1.34.D01.1.454.CMB.1.raw
  modified_base (495)..(495): a, c, t, g, unknown or other
  misc_feature (495)..(495): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcgaaggtcgggtcccatccaggttcaggtggcagtgcatcgtgggacagattacactctcactatcagcagcctgcagcctagaagtattttgctaatttattactgtacaatagtattatacgtacccctagtcggtacgttcggaccgtaggggacctaagggaggaagtaccaaccgaatgnggctgacc

SEQ ID NO: 214011 - DNA, 388 bp, Homo sapiens
  misc_feature: GYAE6OF01BX38V.1.34.D01.1.454.CMB.1.raw
  modified_base (377)..(388): a, c, t, g, unknown or other
  misc_feature (377)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtaccctagtgacgttcggccaggggaccaaggtggaagtcaacgaactgtggctgcacatctgtcttcatctccgcatctgaacgcactcgtctgagcgggctggcaaggcgacatagnnnnnnnnnnnn

SEQ ID NO: 214012 - DNA, 392 bp, Homo sapiens
  misc_feature: GYAE6OF01CDC76.1.34.D01.1.454.CMB.1.raw
  modified_base (385)..(392): a, c, t, g, unknown or other
  misc_feature (385)..(392): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaaggtgggtcccatccaggttcagtggcagtgcatctgggacagattacactctcactatcagcagcctgcagcctgaagattttgactaattttattactgtcaacagtattatagtacccctagtgacgttcggccaggggaccaaggtggaagtcaacgactgtggctgcaccatctgtctcatcttcccgcatctgaacgcactcgtctgaggcggctggaccaaggccgacatagcnnnnnnnn

SEQ ID NO: 214013 - DNA, 514 bp, Homo sapiens
  misc_feature: GYAE6OF01DEQCJ.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcgaaggtgggtcccatccaggttcagtggcagtgcatctgggacagattacactctcactatcagcagcctgcagcctgaagtnttttgctaaattttattactgtacaactagtattatacgtacccctagtcggacgttcgggacgtagggggacctaaaggggtacggaaagtacgaaaccggaactggtacggctgacccg

SEQ ID NO: 214014 - DNA, 526 bp, Homo sapiens
  misc_feature: GYAE6OF01B9OJ0.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccgagggcgacgccccctnagatcgtagtctagtggtgcatccagattgcaagggtcgggtcccagtccgaggttcaggtggcagtgcatcgtaggacagacttacactcacactatcagcagcctgacagcctagaagtattttagacttaattttatactagtacaactagttattatacgtaccctacggtggtaccgttcggaccgaggggtaacccagggtacggaacgtacgaaaccgaagtggtcggctgacc

SEQ ID NO: 214015 - DNA, 495 bp, Homo sapiens
  misc_feature: GYAE6OF01BLS1H.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtccatccaggttcagtggcagtgcatctgggacagattacactctcactatcagcagcctgcagcctagaagtattttgactaatttattactgtacaatagttattactagtaccctagtcgtacgttcggacctaggggacctaaggtaggaagtccaacgaactgtcggctgac

SEQ ID NO: 214016 - DNA, 535 bp, Homo sapiens
  misc_feature: GYAE6OF01CH7DF.1.34.D01.1.454.CMB.1.raw
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (413)..(413): a, c, t, g, unknown or other
  misc_feature (413)..(413): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattctttagctggttgcagcagaaaccngggcgacgcccctnacgatcgtagtctatggtncatccagattgacgaagggtcgggtcccaatcccgaggttcagtcggcagtgcatcgtagggacagtacttaacacttctacaactagtcagcagcctgacacgcctagaagtntttagactaattttatactagtacaatacgtattactacgtacccctaggtacggtacgttcggaccgtaaggggacctaagggtacgaacgtacgtaaccgaactggtacgcgtcggtacc

SEQ ID NO: 214017 - DNA, 563 bp, Homo sapiens
  misc_feature: GYAE6OF01CN985.1.34.D01.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccngggcgagcccctnagatcgtagtctagtggtgcatccagattgcaaggtcgggtcccatccgaggttcagtggcagtgcatcgtgggacagattacactctcactatcagcagcctgcagcctgaacgtattttgactaattttattactgtactaactagttaatttactaacgttaccccgttacgtacgggtaccggtttccgggacccggtaacgggggtaaccggtaaacggggtacggtaaacggttacccgaaacccggtaacgttgggtacgggtccgtcggtaccccg

SEQ ID NO: 214018 - DNA, 388 bp, Homo sapiens
  misc_feature: GYAE6OF01EPOPS.1.34.D01.1.454.CMB.1.raw
  modified_base (383)..(388): a, c, t, g, unknown or other
  misc_feature (383)..(388): n is a, c, g, or t
tcagacgagtgcgtcacgaccggtgctcgatttagatcgtctgtgttgggtttgggagtcaggccatcagcgattctttagcctggttgcagcagaaaccagggagagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatctcccgcatctgaacgcactcgtctgagcgggctgggcaaggcgcatagnnnnnn

SEQ ID NO: 214019 - DNA, 533 bp, Homo sapiens
  misc_feature: GYAE6OF01D4NUD.1.34.D01.1.454.CMB.1.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttgccgggcgagtcaggccatcagcgtattctttagcctggttgcagcagaaaccgngggcgacgcccctanagatcgtagtctatggtncatccagtattgacgaagggtcgggtacccagtcccgaggttcaggtggcagtgcagtcgtagggactagtacttacactctactactatcagcagcctgcagcctagaattatttgacttaagtttatacgtgtacaactagttatactacgtacccctagtcggtacgttcggccgtaagggaccgtaaggtagaacgtaccgaaacgtacgtggtacggctggtacc

SEQ ID NO: 214020 - DNA, 671 bp, Homo sapiens
  misc_feature: GYAE6OF01BSWWU.1.34.D01.1.454.CMB.1.raw
  modified_base (149)..(149): a, c, t, g, unknown or other
  misc_feature (149)..(149): n is a, c, g, or t
  modified_base (158)..(158): a, c, t, g, unknown or other
  misc_feature (158)..(158): n is a, c, g, or t
tcagacgagtgcgtcacgaccggtgctcgatttagatcgtctgtgttgggtttgggggagtcgagaccctgtcgaggacaccaggcatggacatgagggtccccgcgtccaggctccgtgggactcctgctcgctctgctccagtaccngctgtgacnctccaattgacccagtcgtccatccgtccctgtctgcccagtcgtattgggagtcgagtaggtcacctattccaacgttggccggggccgagtccaacggtcccactccagacgtattctttagccctggttgcagcacgaaaccgagggccgaacgcccctagtacgactcgtagtctagtggtgcactccagtacgttgacgtaacgggtcggtaccctagtccgaggttcaggttcggcgtacggtcgactagtccgtagggacctaggtaccttaccggaccttaccgtacctacgttactcccgagtacctacgccgttcgacccgacgtacccgtagtaacgttacgttttccgaccttaagtttacttaccgtcggttacctaaccgtagttacttacgtacccgttaacccgtaggtacggaccgttccggaccggtaacggggacccgtaggggtacgtaaccggttaccgaaccggttaactggtcgtaccgttcggtacccg

SEQ ID NO: 214021 - DNA, 511 bp, Homo sapiens
  misc_feature: GYAE6OF01BNO4M.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctnagatcgtagtctatggtgcatccagtattgcgaaggtgggtcccatccaggttcaggtggcagtgcatcgtgggacagattacactctacactatcagcagcctgcagcctagaagtatttgactaatttattactgtacaactagttattataccgttaccctaggtcggtacggttcggccgtaggggaccaagggtcggaacgtcgaaaccgactggtggctggacc

SEQ ID NO: 214022 - DNA, 490 bp, Homo sapiens
  misc_feature: GYAE6OF01ECO9Z.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtcgggtccagtccaggttcagtggcagtgcatctgggacagattacactctcactatcagcagcctgcagcctagagtattttgctaatttatacttgtacaatagttattactacgtacccctagtggacgttcggaccaggggacaagggtgaagacaacgaactgtgctgacc

SEQ ID NO: 214023 - DNA, 494 bp, Homo sapiens
  misc_feature: GYAE6OF01DVMTJ.1.34.D01.1.454.CMB.1.raw
  modified_base (489)..(489): a, c, t, g, unknown or other
  misc_feature (489)..(489): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtattttgactaatttattactgtacaactagtattactagtaccctagtggacgttcggccgaggggaccaaggtacgaagtcgaaacgactgcggngtgac

SEQ ID NO: 214024 - DNA, 517 bp, Homo sapiens
  misc_feature: GYAE6OF01CFWK4.1.34.D01.1.454.CMB.1.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggtgcagcaagaaccngggcgacgcccctanagatcgtagtctagtggtgcatccagtattgacgtaagggtcgggtacccagtcccgaggttcaggtggctagtgctatcgtagggacagtacttacactctcactatcagcagcctgcagctagaagttntttgacttaatttatactgtacaatagtattactacgtaccctagtcggtacgttcggaccgaggggacctagggtacgaagtaccaacggtactggcgctgacc

SEQ ID NO: 214025 - DNA, 517 bp, Homo sapiens
  misc_feature: GYAE6OF01C2D6V.1.34.D01.1.454.CMB.1.raw
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcacctcagatcgtagtctatggtgcatccagacttgacgaagggtcggggtcccagtccctagggtttcaggttggcagtgctagtcgtgggacagtacttacactctacacttatcagcagcctgcagcctgaatnttttgacttaatttacttactgtacaactagttattatacgttaccctaggtggaccgttcggacgagggaccaagggtgaacgtaccgaacgagtcgtggctacg

SEQ ID NO: 214026 - DNA, 386 bp, Homo sapiens
  misc_feature: GYAE6OF01AYP6M.1.34.D01.1.454.CMB.1.raw
  modified_base (375)..(375): a, c, t, g, unknown or other
  misc_feature (375)..(375): n is a, c, g, or t
  modified_base (381)..(386): a, c, t, g, unknown or other
  misc_feature (381)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgaactgtggctgcaccatctgtcttcatcttccgcatctgaacgcactcgtctgagcgggctggcaaggcncatagnnnnnn

SEQ ID NO: 214027 - DNA, 483 bp, Homo sapiens
  misc_feature: GYAE6OF01D71HR.1.34.D01.1.454.CMB.1.raw
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagattttgctaatttattactgtcaacagtattatagtaccctagtggacgttcggaccgagggaccaaggtggaagtcgaaccgatggtgntgcaccatactgtactnatctcccgc

SEQ ID NO: 214028 - DNA, 500 bp, Homo sapiens
  misc_feature: GYAE6OF01D949P.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccaggggcgagcccctcagatcgtagtctatggtgcatccagattgcaaggtgggtcccatccaggttcagtggcagtgcatctgggacagattacactctcactatcagcagcctgcagcctgaagtnttttgactaatttacttactgtacaactagttattatacgtacccctagtcggacgttcggccgaggggaccaagggtacggaagtacaacgaactgtagcgtgacc

SEQ ID NO: 214029 - DNA, 503 bp, Homo sapiens
  misc_feature: GYAE6OF01BC2JK.1.34.D01.1.454.CMB.1.raw
  modified_base (281)..(281): a, c, t, g, unknown or other
  misc_feature (281)..(281): n is a, c, g, or t
  modified_base (494)..(494): a, c, t, g, unknown or other
  misc_feature (494)..(494): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcaggtggcagtgcatcgtgggacagattacactctacactatcagcagcctgcagcctgaagtatttgactaatttattactgtacaactagtattatacgtaccctagtggtacgttcggcctaggggaccaagggtggaacgtacaaaccgtacgtaggngtcgtgacc

SEQ ID NO: 214030 - DNA, 535 bp, Homo sapiens
  misc_feature: GYAE6OF01EDP0N.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgcaaggtcgggtcccatccgaggttcagtggcagtgcatcgtgggacagattacactctcacttatcagcagcctgcacgcctagaagtattttgacttaattttattactgtactaactagttaattacgtaacgtacccctagtcgggtaccgtttacgggccgtaagggggacctaagggtacggtaagtaccgaaacggtaacgtggtcggtctggtaccc

SEQ ID NO: 214031 - DNA, 486 bp, Homo sapiens
  misc_feature: GYAE6OF01A4Z7D.1.34.D01.1.454.CMB.1.raw
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaattttattactgtacaactagttattatacgtacccctagtcggtacgttcggccaaggggaccaaggtggaagtcaacgatgngcngcacatctgtctnatctcccgc

SEQ ID NO: 214032 - DNA, 426 bp, Homo sapiens
  misc_feature: GYAE6OF01D8BAF.1.34.D01.1.454.CMB.1.raw
  modified_base (348)..(348): a, c, t, g, unknown or other
  misc_feature (348)..(348): n is a, c, g, or t
  modified_base (385)..(426): a, c, t, g, unknown or other
  misc_feature (385)..(426): n is a, c, g, or t
tcagacgagtgcgtcacgaccggtgctcgatttagatcgtctgtgttgggtttgggaggtcaggccatcagcgattctttagcctggttgcagcagaaaccagggcgagcccctcagatcgtagtctatggtgcatccagattgcaaggtggggtcccatccaggttcagtggcagtgcatctgggacacgattacactctcactatcagcagcctgcagcctagaagattttgcaatttatactgtcaacagtattatagtacccctagtgacgttcggccaggggaccaaggtgatcaacgaatgtggctgcaccatctgtcttcatccttcccgccctcctcgcncactcgttcgagcggcgtgcgaaggcgccaatcgagnnnnnnnnnnnnnnnnnnnnnnnnnnnnnnnnnnnnnnnnnn

SEQ ID NO: 214033 - DNA, 419 bp, Homo sapiens
  misc_feature: GYAE6OF01B57SE.1.34.D01.1.454.CMB.1.raw
  modified_base (378)..(378): a, c, t, g, unknown or other
  misc_feature (378)..(378): n is a, c, g, or t
  modified_base (383)..(419): a, c, t, g, unknown or other
  misc_feature (383)..(419): n is a, c, g, or t
tcagacgagtgcgtcacgaccggtgctcgatttagatcgtctgtggttggggtttgggagtcaggccatcagcgattctttagcctggttcgcagcagaaaccagggcgagcccctcagatcgtagtctatggtgcatccagattgcaaggtggggtcccatccaggttcagtggcagtgcagtctgggacagattacactctcactatcagcagcctgcagcctgagtatttgcaatttatactgtcaacagtattatagtacccctagtggacgttcggccagggggaccaaggtggaagtcaaccgaacgtgtaggctgcaccatctgtctcatctccacctctcacgcactcgtctgacgcggctggcaaggcnatagnnnnnnnnnnnnnnnnnnnnnnnnnnnnnnnnnnnnn

SEQ ID NO: 214034 - DNA, 392 bp, Homo sapiens
  misc_feature: GYAE6OF01CD34R.1.34.D01.1.454.CMB.1.raw
  modified_base (384)..(392): a, c, t, g, unknown or other
  misc_feature (384)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgagcgggctggcaagggcgcatagnnnnnnnnn

SEQ ID NO: 214035 - DNA, 488 bp, Homo sapiens
  misc_feature: GYAE6OF01EQPPU.1.34.D01.1.454.CMB.1.raw
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcaaggtcgggtcccatccgaggttcagtagcagtgcatcgtgggacagattacactctcactatcagcagcctgcacgcctagaagtattttgactaatttatactgtacaactatatatacgtaccctacgtggacgttcggcgagggacaggtgaagtacaacgactgngctgac

SEQ ID NO: 214036 - DNA, 400 bp, Homo sapiens
  misc_feature: GYAE6OF01DMBSH.1.34.D01.1.454.CMB.1.raw
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (391)..(400): a, c, t, g, unknown or other
  misc_feature (391)..(400): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtcaacagttattatacgtacccctagtggacgttcggccaggggaccaaggtggaagtcaaccgaatgnggctgcacatctgtcttcatccttcccgcatcngaacncactcgtctgaggcgggctggcaaggcgacagtagnnnnnnnnnn

SEQ ID NO: 214037 - DNA, 384 bp, Homo sapiens
  misc_feature: GYAE6OF01EN99T.1.34.D01.1.454.CMB.1.raw
  modified_base (376)..(376): a, c, t, g, unknown or other
  misc_feature (376)..(376): n is a, c, g, or t
  modified_base (382)..(384): a, c, t, g, unknown or other
  misc_feature (382)..(384): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaattttatactgtcaacagtattatagtacccctagtggacgttcggccagggggaccaaggtggaagtcaaccgaactgtgctgcacatctgtcttcatcttcccgcatctgaacgcactcgtctgagcgggctggcaaggcncatagnnn

SEQ ID NO: 214038 - DNA, 524 bp, Homo sapiens
  misc_feature: GYAE6OF01BU8PG.1.34.D01.1.454.CMB.1.raw
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctcagatcgtagtctatggtgcatccagattgcgaagggtcgggtcccatccaggttcaggtggcagtgcagtcgtgggacagattacactctcactatcagcagcctgccagcctagaagtntttgacttaatttatactgtacaatagttattactacgtaccctagtggtaccgttcggaccgtaggggacctagggtacggtaaacgtaccgaaaccggtacgtggtggtcctggtaccc

SEQ ID NO: 214039 - DNA, 496 bp, Homo sapiens
  misc_feature: GYAE6OF01BUKG2.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccaatccaggttcagtggcagtgcatcgtgggacagattacactctcactatcagcagcctgcagcctgaagtattttgactaatttattactgtacaactagtattatacgtaccctagtcggtacgttcggccgaagggaccgaaggtaggaagtacaacgactgtgctgacc

SEQ ID NO: 214040 - DNA, 495 bp, Homo sapiens
  misc_feature: GYAE6OF01A1Q4Q.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgactaattttatactgtacaactagttattatacgtacccctagtggacgttcggccgaggggaccaaggtggaagtcgaaccgactggtggctgacc

SEQ ID NO: 214041 - DNA, 514 bp, Homo sapiens
  misc_feature: GYAE6OF01EMYNQ.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctcagatcgtagtctatggtgcatccagattgcaaggtcgggtcccatccaggttcagtggcagtgcatctgggacagattacactctcactatcagcagcctgcagcctgaagtattttgctaatttattactgtacaactagttattactacgtacccctaggtcggtaccgttcggccgagggggaccctaagggtcggaacgtaccgaaaccggaactggtcggctggtacc

SEQ ID NO: 214042 - DNA, 388 bp, Homo sapiens
  misc_feature: GYAE6OF01DIPIZ.1.34.D01.1.454.CMB.1.raw
  modified_base (376)..(376): a, c, t, g, unknown or other
  misc_feature (376)..(376): n is a, c, g, or t
  modified_base (382)..(388): a, c, t, g, unknown or other
  misc_feature (382)..(388): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaagggtcggggtcccatccaggttcagtggcagtgcatctgggacagattacactctcactatcagcagcctgcagcctgaagtattttgctaattttatactgtacaatagtattatacgtacccctagtggacgttcggccaggggaccaaggtgaagtcaacgactgtggctgcacatctgtcttcatcttcccacctctcacgcactcgtctgagcggctggcaaggcncatagnnnnnnn

SEQ ID NO: 214043 - DNA, 569 bp, Homo sapiens
  misc_feature: GYAE6OF01B7C2I.1.34.D01.1.454.CMB.1.raw
  modified_base (301)..(301): a, c, t, g, unknown or other
  misc_feature (301)..(301): n is a, c, g, or t
tcagacgagtgcgtcacgaccggtgctcgatttagatcgtctgtgttgggttgggggagtcgagaacccgtgtcaaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcacgcccctcagatcgtagtctatggtncatccagtattgcgtaaggtcgggtcccagtccaggttcagtggcaggtgcagtcgtgggacagacttacacttctacactatcagcagcctgcacgcctagaagttattttgactaagttttatactgtactaactagtattataccgtaaccccgttaggtacggtaccggttaccgggacccggtaagggggtaacccgtaaaggggtacgggtaaacgtacccggtaaaacccggtacgttaggtacgggtccgttggaacccc

SEQ ID NO: 214044 - DNA, 389 bp, Homo sapiens
  misc_feature: GYAE6OF01D3QAC.1.34.D01.1.454.CMB.1.raw
  modified_base (376)..(376): a, c, t, g, unknown or other
  misc_feature (376)..(376): n is a, c, g, or t
  modified_base (382)..(389): a, c, t, g, unknown or other
  misc_feature (382)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctacgtggacgttcggccaggggaccaaggtggaagtcaaccgaactgtggctgcaccatctgtcttcatctcccgcatctgaacgcactcgtctgagcgggctggcaaggcncatagnnnnnnnn

SEQ ID NO: 214045 - DNA, 507 bp, Homo sapiens
  misc_feature: GYAE6OF01BL3PS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctagtggtgcatccagattgcaaggtgggtcccatccgaggttcagtggcagtgcatcgtgggacagattacactctcactatcagcagcctgcagcctagaagtatttgataatttattactgtactaatagttattactacgtacccctaggtcggacgttcggaccgtaggggaccaagggtaggaacgtcgaaccggactgtcggtctgacc

SEQ ID NO: 214046 - DNA, 503 bp, Homo sapiens
  misc_feature: GYAE6OF01DQCTI.1.34.D01.1.454.CMB.1.raw
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtncatccagattgcaagggtgggtcccatccaggttcagtggcagtgcatcgtgggacagattacactctacactatcagcagcctgcagcctagaatattttgactaatttattactgtacaactagttaattataacgttacccctaggtcggtacgttcggccgaggggactaaggtggaagtcgaaacgtactgtggctgacc

SEQ ID NO: 214047 - DNA, 536 bp, Homo sapiens
  misc_feature: GYAE6OF01DV0D4.1.34.D01.1.454.CMB.1.raw
  modified_base (281)..(281): a, c, t, g, unknown or other
  misc_feature (281)..(281): n is a, c, g, or t
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtcgggtcccatccaggttcagtggcagtgcatcgtgggacagattacactctcaactatcagcagcctgcagcctgaatnttttgctaattttattacgtgtacaaactagttaattacgtaacgttacccctaggtcggtacgtttccggaccgtaagggggaaccctaaggggtacgaaacgtaccgaaaccggtaaacttggtcgggcctggaacccg

SEQ ID NO: 214048 - DNA, 642 bp, Homo sapiens
  misc_feature: GYAE6OF01DCUJW.1.34.D01.1.454.CMB.1.raw
  modified_base (255)..(255): a, c, t, g, unknown or other
  misc_feature (255)..(255): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaaggtgggtcccatccaggttcaggtgcagtcgcatcgtaggacagtacttacactctactactactacgacgacgacgtccgtacgaccgtacgtccgtaagtaaagtttacgtttacgactttaaagttttactttacgttacgtaacgtaaacttagttaactttaacgttaacccgttaacccgttagggtacggttaccggttccggaaccgggtaacggggtaaaccggtaagggtaacgggtaaccgtaccggtaaacccgtaacggttcgggtcgtacggttacgaccgtaacctagttccgttacggtttacccttacgtaccttccccgttacccccgttaaccccg

SEQ ID NO: 214049 - DNA, 475 bp, Homo sapiens
  misc_feature: GYAE6OF01B8B5B.1.34.D01.1.454.CMB.1.raw
  modified_base (422)..(422): a, c, t, g, unknown or other
  misc_feature (422)..(422): n is a, c, g, or t
  modified_base (471)..(471): a, c, t, g, unknown or other
  misc_feature (471)..(471): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgatctttagcctggttgcagcagaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtaattanagtaccctagtgacgttcgcgagggaccaaggtgaagtcacgactgtgntgac

SEQ ID NO: 214050 - DNA, 390 bp, Homo sapiens
  misc_feature: GYAE6OF01DBR1F.1.34.D01.1.454.CMB.1.raw
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgactaatttattactgtcaactagtattatagtacccctagtgacgttcggccaggggaccaaggtggaagtcaacgaactgtggctgcaccatctgtcttcatcttcccgcatctgaacgcactcgtctgagcgggctggcaaggcgcatagnnnnnnnn

SEQ ID NO: 214051 - DNA, 553 bp, Homo sapiens
  misc_feature: GYAE6OF01BLSAP.1.34.D01.1.454.CMB.1.raw
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaagggtcgggtcccagtccaggttcagtggcagtgcatcgtgggacagtattacactctacactatcagcacgcctgcagcctagaagtattttgacttaatttattactgtacaactagttattactacgttacccctaggtggtaccgttcgggaccgacggggtaaccgaagggtacggaagtaccgaaaccggtaacgttggtcggtctacggcctacctacgttcgttacgtactttacctacttcccgttccccggtacc

SEQ ID NO: 214052 - DNA, 518 bp, Homo sapiens
  misc_feature: GYAE6OF01EGQFH.1.34.D01.1.454.CMB.1.raw
  modified_base (280)..(280): a, c, t, g, unknown or other
  misc_feature (280)..(280): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgacaagggtcgggtcccatccaggttcaggtggcagtgcatcgtgggacagattacactctcactatcagcagcctgcagcctagaagtnttttgacttaatttacttactgtacaactagttattactacgtacccctaggtcggacgttcgggaccgagggggaaccaagggtaggaacgtaccgaaaccggactggtcggctgaccc

SEQ ID NO: 214053 - DNA, 390 bp, Homo sapiens
  misc_feature: GYAE6OF01A9ZUI.1.34.D01.1.454.CMB.1.raw
  modified_base (380)..(380): a, c, t, g, unknown or other
  misc_feature (380)..(380): n is a, c, g, or t
  modified_base (386)..(390): a, c, t, g, unknown or other
  misc_feature (386)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtgactgcaccatctgtcttcatcttcccaccctcctcacgcactcgtctgagcgggctgggcaaggcncatagnnnnn

SEQ ID NO: 214054 - DNA, 388 bp, Homo sapiens
  misc_feature: GYAE6OF01D6SJE.1.34.D01.1.454.CMB.1.raw
  modified_base (383)..(388): a, c, t, g, unknown or other
  misc_feature (383)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacttcggccaggggaccaaggtggaagtcaaccgaactgtggctgcaccatctgtcttcatcttcccaccctctcacgcactcgtctgagcgggctggcaaggcgcatagnnnnnn

SEQ ID NO: 214055 - DNA, 518 bp, Homo sapiens
  misc_feature: GYAE6OF01CBDIA.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaagggtcgggtcccagtccgaggttcaggtggctagtgcatcgtgggacagattacactctcactatcagcagcctgcagcctagaagtattttgactaatttatactgtacaactagttattatacgttacccctaggtcggtaccgttcggaccgaagggggacctaagggtgaaacgtccgaaaccgtactggtcggctggaccc

SEQ ID NO: 214056 - DNA, 552 bp, Homo sapiens
  misc_feature: GYAE6OF01AMD6R.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcgagccccctcagatcgtagtctatggtgcatccagattgcaaggtgggtcccatccaggttcagtggcagtgcatctgggacagtactacactctactactatacacgacacgccgtgacgacgtcctaagtaagtttattttacgaactttaatttaacttacgtcgtacaaacttagttaattacgttaaccgtaccccgtaggtacggtacggttccggaccggtacgggacgtaaggtaggaacgtaccgaacggtacgtggtacgcgtagaccc

SEQ ID NO: 214057 - DNA, 695 bp, Homo sapiens
  misc_feature: GYAE6OF01EQJFO.1.34.D01.1.454.CMB.1.raw
  modified_base (219)..(219): a, c, t, g, unknown or other
  misc_feature (219)..(219): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
tcagacgagtgcgtcacgaccggtgctcgatttagatcgtctgtgttgggggtttgggggagtcaggacccgtgtcaggacacaggacatggacatggacgggtccccgcctcagctcctccggggcctcctgtctgctctggctcccaggtaccagctgtgacatccaattcgacccagtcctccgatcctcctgtcctggcaagtctagtggagacngagtcacgatcacttagccgggcaagtacaggccatcagcatcttagctggtgcagcagaaccngggcagtcccctnagatacgtagtcctagtggtcncatcagtattgcgaaggtcgggccatccgaggtcaggtcggcagtgctatcgtgggacgagtagttacgacgtctacgaacgttataccgagtactacgtccctggacccaaggtacccgtaaggtaacgtttacgtttttacggaacttaaagttttttaagttaccggttaggttaaccggaaacggttaaggttaaactttaacggttaaccggttaacccccgttaacgggttaccgggtaaaccggttttcccggggaacccggtaacgggggggtaacccgtaaacgggggttaccgggtaaaacccggtttacccggtaaaaccccggtaacgttaccggggttcgggtaccccgttacggtaacccccg

SEQ ID NO: 214058 - DNA, 506 bp, Homo sapiens
  misc_feature: GYAE6OF01DIN60.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgccagcctagaagtattttgcttaaatttattactgtacaaatagttaattatacgtacccctagtggtacgttcggccgaggggacctaaagggtcggaagtacaaccgaactggtacgctgacc

SEQ ID NO: 214059 - DNA, 715 bp, Homo sapiens
  misc_feature: GYAE6OF01BRBXA.1.34.D01.1.454.CMB.1.raw
  modified_base (111)..(111): a, c, t, g, unknown or other
  misc_feature (111)..(111): n is a, c, g, or t
  modified_base (134)..(134): a, c, t, g, unknown or other
  misc_feature (134)..(134): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttggggtttagggggagtcagaccctgtcgaggaccacacgcgattggacattgagggttccccgntcagctcctgggctctgctgctntggcttcccgaggtaccatctgtgactatccaattcgtaacccagtcctccatcctcctgtctgctatctagttgggagacagacgtccacgatcgacgttgccgggtcagtcaggccatcgagcgtacttctttagcctggttgcagcgaacggaaaccgnggggccgacgccccgtacgacggagtccgtagtcgtagtggtcgactatcgagtattaggacgtaagggtcgggtaccagtaccgtaggttcaggtcggctaggtcggacgtacgtcgtacgggactacgtaacttaccgaacttccttacgtaacttagtacacgaccgacgtccgtagaccaacgtacctaaggtaaacgttacgtttttacgaacgtttaaacgtttaacgttaccggtaacgttaacctaaaccgttaagtttaacttaacgttaccggttaaccccgttaggtaccgggtaaccgtttccgggaacccggtaagggggaacccttaaacgggggttaccggtaaacccggttacccggtaaacccggttaaccgttagggttaccggtccgtacggtaacccgg

SEQ ID NO: 214060 - DNA, 512 bp, Homo sapiens
  misc_feature: GYAE6OF01A5HQ3.1.34.D01.1.454.CMB.1.raw
  modified_base (280)..(280): a, c, t, g, unknown or other
  misc_feature (280)..(280): n is a, c, g, or t
  modified_base (506)..(506): a, c, t, g, unknown or other
  misc_feature (506)..(506): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaaggtcggggtcccagtccgaggttcaggtggcagtgcatcgtgggacagtattacactctcactatcagcagcctgcagtcctagaagtattttgacttaatttatactagtacaatagttattataccgtaccctagtcggacgttcggcgtaggggacaagggtagaacgtaccgaaccgaacgtggtacgntgaccg

SEQ ID NO: 214061 - DNA, 537 bp, Homo sapiens
  misc_feature: GYAE6OF01DZL22.1.34.D01.1.454.CMB.1.raw
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctcagatcgtagtctatggtgcatccagattggacaagggtcgggtcccagtcccgaggttcaggtggcaggtgcagtcgtgggacagattacnctctcactatcagcagcctgcagcctgaatntttgacttaattttattactgtacctaacgtagttaattacgtaaccgtacccgtagttccggacggtttcgggaccgtaaggggtacctaaaggggtagaaacgtacgaaccgtaacgtggtacgctgacc

SEQ ID NO: 214062 - DNA, 509 bp, Homo sapiens
  misc_feature: GYAE6OF01CGUIW.1.34.D01.1.454.CMB.1.raw
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (367)..(367): a, c, t, g, unknown or other
  misc_feature (367)..(367): n is a, c, g, or t
  modified_base (416)..(416): a, c, t, g, unknown or other
  misc_feature (416)..(416): n is a, c, g, or t
  modified_base (505)..(505): a, c, t, g, unknown or other
  misc_feature (505)..(505): n is a, c, g, or t
tcagacgagtgcgtcacgaccggtgctcgatttagatcgtctgtggttggggtttgggggagtcagaccctgtcaggacacagcatggacatggagggtccccgctcagctccgtggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccnggggcgacgcccctnagatcgtagtctagtggtgcatccagattggacaaggggtcgggtacccagtccgaggttcaggtggcagtgctagtcgngggacagtacttacactctacactatcagcagcctgcagcctagaagtntttagactaatttatactgtacaatattattactacgtaccctaggtcgtacgtcggcgagggacaggacgaagtcgaaacgatggcgntgac

SEQ ID NO: 214063 - DNA, 521 bp, Homo sapiens
  misc_feature: GYAE6OF01AOMYS.1.34.D01.1.454.CMB.1.raw
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgttacatccaattgacccagtctccatccctccctgtctgcatctattggagacagagtcaccatcacttgccgggngagtcaggccatcagcgattctttagcctggttgcagcagaaaccagggcgagcccctnagatcgtagtctatggtgcatccagattgcgaaggtcggggtcccatccaggttcagtggcagtgcatcgtggacagattacactctcactatcagcagcctgcagcctaggaatattttgacttaatttacttactgtacaactagttattatacgtaccctaggtcggtaccgttcggccgaaggggaccaagggtcggaaacgtccgaaaccggtactggtaggcttcgaccgtac

SEQ ID NO: 214064 - DNA, 531 bp, Homo sapiens
  misc_feature: GYAE6OF01A80OT.1.34.D01.1.454.CMB.1.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaccngggcagcccctnacgatcgtagtctatggtgcgatccgagtattcgacgaagggtgggtcccgtactcaggttcagtggcagtgcatcgtgggacagattacactctacactatcacgtacacgtcctgcagaccctagtaacgtattttgacgtaattttattacttgtactaactattattaactacgtacccttagtggtaccgttcggccgagggaccgtaaggtacggaagtaccgaacgtaacgtagtcggtctgtaccg

SEQ ID NO: 214065 - DNA, 626 bp, Homo sapiens
  misc_feature: GYAE6OF01B297Y.1.34.D01.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcaagaaaccgagggcgacgcccctnagatcgtagtctatggtncatccagtattgacgaagggttcgggtacccagtcccgaggttcaggttggactaggtgactagtcgtgggaacagtaacttaccacttctacacttatcgaagcagcctgcgagtacctaggaattacttttagacttaaattttacgttactcgtacaaacgttattaacgtttactaaccgttaacccccgttagggttacggtaacccggtttaccggggacccggtaagggggtaaccccgtaaaggggttacggggaaaaccgttacccggtaaaacccggttaaacggttgggtacgggtccgttacggtaaccccg

SEQ ID NO: 214066 - DNA, 657 bp, Homo sapiens
  misc_feature: GYAE6OF01DJIGN.1.34.D01.1.454.CMB.1.raw
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactcctcctgtctgctatctagtggagactagactcacatctacgttcggccgggnacgtcaggccatcgagtcgtattttcgttacgcgttggttcgacagacaaaggaaaccgngggacgtaaccgcccctagagtactccggttaagtctaagtcggtacnctaactccgaagtacgttcgaacggtaacggggtcgggtacccaagttcccggaggttcaggttcggacagttcgctagtcgtagggaactagacttacactctactactatcagcacgtcctgacacgtcgtaggtaagtagtttacgaactttaaatttacttacgtacgttaacaacgttaagttaacttaacgtaaccgttacccgtaacggtacgggttaccggttccgggaaccggtaacgggggtaaccgtaaacggggttaacgaacggttaaccgtaaaccggtaacgtaggtacgtacggtcgtaacccg

SEQ ID NO: 214067 - DNA, 492 bp, Homo sapiens
  misc_feature: GYAE6OF01BRZTY.1.34.D01.1.454.CMB.1.raw
  modified_base (280)..(280): a, c, t, g, unknown or other
  misc_feature (280)..(280): n is a, c, g, or t
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaagggtcgggtcccatccaggttcaggtggcagtgcatcgtgggacagtacttacactctacactatcagcagcctgcagcctagaagtattttgacttaatttatactgtacaatagtattatacgtaccctagtcggacgttcggcgaggggaccaggtgaagtacacgatgngctgacc

SEQ ID NO: 214068 - DNA, 489 bp, Homo sapiens
  misc_feature: GYAE6OF01EFQ7P.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgactaatttattactgtacaactagtattatacgtaccctacgtggacgttcggccgagggaccgaggtggaagtcgaaccgactgtgctgcc

SEQ ID NO: 214069 - DNA, 392 bp, Homo sapiens
  misc_feature: GYAE6OF01B8WSM.1.34.D01.1.454.CMB.1.raw
  modified_base (387)..(392): a, c, t, g, unknown or other
  misc_feature (387)..(392): n is a, c, g, or t
tcagacgagtgcgtcacgaccggtgctcgatttagatcgtctgtgttgggtttgggagtcaggccatcagcgatttctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgactaattttattactgttacaacagtattatacgtacccctagtggacgttcggccaggggaccaaggtgaagtcaacgactgtgctgcacatctgtcttcatcttcccgcatctgaacgcactcgtctgagcgggctggcaaggcacatagnnnnnn

SEQ ID NO: 214070 - DNA, 890 bp, Homo sapiens
  misc_feature: GYAE6OF01B1NEA.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgcctcgtgcctcccgaggtaccagctgtcgacactacctaagttccgaaccctagtccctaccacttccccttcccgttgttcctcgactacttcttagttggaacgaacgaggactaccaacctactcctacgttcggccgggacgacgtaccgacggacctagtcgacgacgttacttttccgtttacgtccgttgggttacgacgacgaccgaaacggaaaccggacggggaccgacccgtccccctagaacgtacgttaccggttacgtacttaggttcggtacgacctacgtaccgtaagttagttacggacggtaacgggggtttcccgggtaacccctacgttacccggttacgggtttaccgaacgggttcggaccgtaagggttcgtaccgtacgttaccgggttaacggggaaccttaagggttaacctttaacccgtaccgtttaccttaacctaacgttaactaccggaacgtcccgtaaccgtcccgtacggacctacccggtaacccgttaaggttaaacgttttacgtttttccgaaatttttaacgtttttaaccttaaccggttagttaacccttaaacgtttaacgtttaacgttttaacccgtaaaccccggtttaccccggttagggttacccgggttaccgggtttacccgggaaccccggggtaaggggtaaaccccgtaaaggggttacggtaacccgttaaacccgtaaaccggtaggttcggtacggtccgtacgtaacccg

SEQ ID NO: 214071 - DNA, 501 bp, Homo sapiens
  misc_feature: GYAE6OF01C6TD4.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctcagatcgtagtctatggtgcatccagattgcaaggtgggtcccatccaggttcagtggcagtgcatctgggacagattacacttctcactatcagcagcctgcagcctgaagtattttgactaatttactactgtacaactagttattatacgtacccctagtggtacgttcggccgaggggaccaagggtcgaaactccgaaacgaactgtcggctgacc

SEQ ID NO: 214072 - DNA, 511 bp, Homo sapiens
  misc_feature: GYAE6OF01CSBPP.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagacttacactctcactatcagcagcctgcagcctagaagtnttttgacttaatttattactgtacaatagttattatactaccctagtcggtacgttccggcgaggggaacctagggtacggaacgtacgaaaccggaacttggtacggcgtgaacc

SEQ ID NO: 214073 - DNA, 551 bp, Homo sapiens
  misc_feature: GYAE6OF01E4KBG.1.34.D01.1.454.CMB.1.raw
  modified_base (406)..(406): a, c, t, g, unknown or other
  misc_feature (406)..(406): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctagtggtgcatccagattgcgaagggtcgggtcccagtccaggttcaggtggcaggtcgcagtcgtgggacagtattacactctacactatcagcacgcctgcagcctgaagtntttgacttaatttatactgtactaaacgtagttattacgtaccgtacccctaggtacgggtaccgtttcgggaccgtaagggggaaccctaaaggggtacggtaaacgtaccgaaaccggtaacgttaggtcgggtctcggaccc

SEQ ID NO: 214074 - DNA, 382 bp, Homo sapiens
  misc_feature: GYAE6OF01DV0RB.1.34.D01.1.454.CMB.1.raw
  modified_base (373)..(373): a, c, t, g, unknown or other
  misc_feature (373)..(373): n is a, c, g, or t
  modified_base (378)..(382): a, c, t, g, unknown or other
  misc_feature (378)..(382): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctagtggacgttcggcaggggaccaaggtggaagtcaacgactgtggctgcaccatctgtcttcatctcccgcatctgaacgcactcgtctgagcgggctggcaaggcgnatagnnnnn

SEQ ID NO: 214075 - DNA, 708 bp, Homo sapiens
  misc_feature: GYAE6OF01DWI44.1.34.D01.1.454.CMB.1.raw
tcagacgagtgcgtcacgaccggtgctcgatttagatcgtctgtgttgggtttgggggagtcagaaccctacgtcaggtaccaccagacaatccggacgatgaggtcccgctcagctcctgggctcctgctgctctgtctccgaggtaccagctgtgacagtccaattgacccagtctctagtctccctagtctggctagtcgtattaggagacctaggacgttcgacagttcaccttggccgggacgacgttcagggccgatcctagcgattctttagccttggttagtcgtagcgaacggaaaccagggtcgacgaccccgtctaggagtcggtagtcgtaagtggtcgcctatccgtagacttcgactaacggtcgggtcccaagtaccgaaggtttccaaggtcggcgaacgtcgaccataccgtgggaacaagtaacgttaacacttacgttactactagtacacgtacacgtcctgtcgacgtacctagtaagtagttttcgacgttaatttttacgttaaccgttgttacgtaaacgttaggttaacgtttaagttaaccggtttaaaccccttaaggttaaccggtaaccggttttccgggtacccggttaaacggggtttaaccctaaaccggggtttaccggtaacggttaacccgtaaaccggtaacggttcgtacgggtccgtacccgggtaaccc

SEQ ID NO: 214076 - DNA, 534 bp, Homo sapiens
  misc_feature: GYAE6OF01AZMCA.1.34.D01.1.454.CMB.1.raw
  modified_base (417)..(417): a, c, t, g, unknown or other
  misc_feature (417)..(417): n is a, c, g, or t
  modified_base (527)..(527): a, c, t, g, unknown or other
  misc_feature (527)..(527): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccgagggcgacgcccctcagactcgtagtctatggtgcatccagattgacgtaagggtcgggtacccagtcccgaggttcaggtggcagtcgctagtcgtgggacagtacttacactctactactatcagcacgcctgcagcctagaagtntttgacttaatttactactgtacaactgtaattactacgtaccctaggtacggtaccggttcggcgaggggacctaggggtacgaagtaccgaaaccggtaatggtcggntcgtacc

SEQ ID NO: 214077 - DNA, 501 bp, Homo sapiens
  misc_feature: GYAE6OF01E5C3X.1.34.D01.1.454.CMB.1.raw
  modified_base (494)..(494): a, c, t, g, unknown or other
  misc_feature (494)..(494): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctcagatcgtagtctatggtgcatccagtattgcgaagggtcgggtcccagtccgaggttcagtggcagtgcatcgtgggacagatacactctacactatcagcagcctgcagcctagaagtattttgactaatttattactagtacaactagttattactacgtaccctagtacggacgttcggccgagggaccaggtagaacgtcaacgactgngctgacc

SEQ ID NO: 214078 - DNA, 509 bp, Homo sapiens
  misc_feature: GYAE6OF01B9R0J.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtatttgactaatttatactgtacaatagttattactacgtacccctagtcggtacgttcggaccgaggggaccagggtacggaacgtaccaaaccgtactggtcggctcgcaccattcctgttccttacacttctccccgac

SEQ ID NO: 214079 - DNA, 391 bp, Homo sapiens
  misc_feature: GYAE6OF01BKE6A.1.34.D01.1.454.CMB.1.raw
  modified_base (376)..(376): a, c, t, g, unknown or other
  misc_feature (376)..(376): n is a, c, g, or t
  modified_base (382)..(391): a, c, t, g, unknown or other
  misc_feature (382)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgagcgggctggcaggcncatagnnnnnnnnnn

SEQ ID NO: 214080 - DNA, 539 bp, Homo sapiens
  misc_feature: GYAE6OF01A6M9J.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctgaagtattttgactaattttattactgtactaaactagttattatacgtaccccttacggtcggtaaccgtttccgggcccgtaagggggaacccaaaggggttacgggaaacgttaccgaaacccggtaacgtaggtcgggccgttggaccc

SEQ ID NO: 214081 - DNA, 486 bp, Homo sapiens
  misc_feature: GYAE6OF01E1ZLL.1.34.D01.1.454.CMB.1.raw
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttatactgtcaacagtattatagtacccctagtggacgttcggccaggggaccaaggtggaagtcgaaccgactgnggtctgacc

SEQ ID NO: 214082 - DNA, 394 bp, Homo sapiens
  misc_feature: GYAE6OF01C327G.1.34.D01.1.454.CMB.1.raw
  modified_base (387)..(394): a, c, t, g, unknown or other
  misc_feature (387)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtacaacagtattatagtacccctagtggacgttcggccaggggaccaagggtggaagtcaaccgactgtggctgcaccatctgtcttcatcttcccgtcatctgaacgcactcgtctgacgcgggctggcaaggcgacatagnnnnnnnn

SEQ ID NO: 214083 - DNA, 390 bp, Homo sapiens
  misc_feature: GYAE6OF01DO5N6.1.34.D01.1.454.CMB.1.raw
  modified_base (385)..(390): a, c, t, g, unknown or other
  misc_feature (385)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgaactgtggctgcaccatctgtcttcatccttcccgccatctgaacgcactcgtctgagcgggctggcaaggcacatgnnnnnn

SEQ ID NO: 214084 - DNA, 513 bp, Homo sapiens
  misc_feature: GYAE6OF01AG3XW.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtcgggtcccatccaggttcagtggcagtgcatctgggacagattacactctcactatcagcagcctgcagcctgaagtntttgactaatttatactgtacaatagttattatacgtaccctagtacggtacgttcggaccgtaggggacctaagggtggaaacgtaccgaaaccggtaactaggtcggtcgtgtaccg

SEQ ID NO: 214085 - DNA, 392 bp, Homo sapiens
  misc_feature: GYAE6OF01DKY2H.1.34.D01.1.454.CMB.1.raw
  modified_base (385)..(392): a, c, t, g, unknown or other
  misc_feature (385)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctacgtggacgttcggccagggggaccaaggtggaagtcaaccgaactgtggctgcaccatctgtcttcatcttcccacctcctcacgcactcgtctgagcgggctggcaaggcgacatagnnnnnnnn

SEQ ID NO: 214086 - DNA, 488 bp, Homo sapiens
  misc_feature: GYAE6OF01DVE2E.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatcgtgggacagtattacactctcactatcagcagcctgcagcctagaagtattttgactaatttattactgtacaactagtattatacgtaccctagtggtacgttcggccgaggggacaggtagagtacaacgactgtgctgc

SEQ ID NO: 214087 - DNA, 395 bp, Homo sapiens
  misc_feature: GYAE6OF01CO4CM.1.34.D01.1.454.CMB.1.raw
  modified_base (313)..(313): a, c, t, g, unknown or other
  misc_feature (313)..(313): n is a, c, g, or t
  modified_base (358)..(358): a, c, t, g, unknown or other
  misc_feature (358)..(358): n is a, c, g, or t
  modified_base (388)..(395): a, c, t, g, unknown or other
  misc_feature (388)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaattttattactgtcaacagtattatacgtaccctagtggacgttcggaccagggaccaaggtgaagtcaaccgaactgnggctgcacatctgtcttcatctcccgcatctgaacgcactcgtcngacggcgggctcgggacaagggcacatagnnnnnnnn

SEQ ID NO: 214088 - DNA, 626 bp, Homo sapiens
  misc_feature: GYAE6OF01DEENW.1.34.D01.1.454.CMB.1.raw
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatccctccctgtctgcatctattggagacagagtcaccatcacgttggccgggcagtcaggccatcagcgtattcttagcctggtgcagcagaaccgagggcgacgccctgagatcgtagtctagtggtncatccagattcgacgaagggttcgggacccagtccgtaggttcaggtggcagtgcagtcgtagggacaagtactacgactctacacttacacgagtcacgtcctgacacgtcctaggtaattacgtttagactttaattttacttaactcgttaactaacttaagtttaactttaacgtaaccgttacccccgtaggttaccgggtaccgggttaccggaccggtaacggggtaaccgtaaggggtacggtaaacgtaccgtaaaccggtacgttcggtacggtactacggcctaaccgtattacccgttcgtttacttacccgttacccttcccgttccccgtaacccg

SEQ ID NO: 214089 - DNA, 484 bp, Homo sapiens
  misc_feature: GYAE6OF01DO8JS.1.34.D01.1.454.CMB.1.raw
  modified_base (255)..(255): a, c, t, g, unknown or other
  misc_feature (255)..(255): n is a, c, g, or t
  modified_base (470)..(470): a, c, t, g, unknown or other
  misc_feature (470)..(470): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctnagatcgtagtctatggtgcatccagattgcaaggtgggtcccatccaggttcagtggcagtgcatctgggacagatacactctcactatcagcagcctgcagcctgaagtatttgactaatttattactgtacaactagtattatacgtaccctagtgtacgttcggccgagggaccaggtggaagtcgaaccgatgtggctgcacatctgtctnactcctcccgtccc

SEQ ID NO: 214090 - DNA, 392 bp, Homo sapiens
  misc_feature: GYAE6OF01EK3YM.1.34.D01.1.454.CMB.1.raw
  modified_base (385)..(392): a, c, t, g, unknown or other
  misc_feature (385)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgaactgtggctgcaccatctgtcttcatcttcccgccatctgaacgcactcgtctgagcgggctggcaaggcgcatagnnnnnnnn

SEQ ID NO: 214091 - DNA, 488 bp, Homo sapiens
  misc_feature: GYAE6OF01BWXJT.1.34.D01.1.454.CMB.1.raw
  modified_base (256)..(256): a, c, t, g, unknown or other
  misc_feature (256)..(256): n is a, c, g, or t
  modified_base (375)..(375): a, c, t, g, unknown or other
  misc_feature (375)..(375): n is a, c, g, or t
  modified_base (461)..(461): a, c, t, g, unknown or other
  misc_feature (461)..(461): n is a, c, g, or t
  modified_base (478)..(478): a, c, t, g, unknown or other
  misc_feature (478)..(478): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgccctnagatcgtagtctatggtgcatccagtattgcaagggtcgggtcccatccgaggttcaggtggcagtcgcatcgtgggacagattacactctcactatcagcagcctgcagctagaagtntttgactaatttatactgtacaatagtattatacgtaccctaggtcgacgttcggacgagggaccaggtgaagcaacgactgtcgntgcacctatctgtctanctcctccgac

SEQ ID NO: 214092 - DNA, 517 bp, Homo sapiens
  misc_feature: GYAE6OF01BOU46.1.34.D01.1.454.CMB.1.raw
  modified_base (282)..(282): a, c, t, g, unknown or other
  misc_feature (282)..(282): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggcgacgcccctnagatcgtagtctatggtgcatccagtattggcgtaagggtcgggtcccagtccgaggttcaggtggcagtgctatcgtgggacagattacactctcactatcagcagcctgcagcctagaagttntttgacttaatttattactgtacaactagttattatacgtaccctaggtggtacgttcggaccgaggggaccaagggtacgaacgtaccgaacgacgtgtacgcgtgacc

SEQ ID NO: 214093 - DNA, 496 bp, Homo sapiens
  misc_feature: GYAE6OF01BHME0.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcgagcccctcagatcgtagtctatggtgcatccagattgcaaggtgggtcccatccaggttcagtggcagtgcatctgggacagattacactctcactatcagcagcctgcagcctgaagtattttgactaattttattactgtacaactagttattatacgtacccctagtggaccgttcggccgaggggaccaaggtggaagtcgaacgactgtcgctgacc

SEQ ID NO: 214094 - DNA, 451 bp, Homo sapiens
  misc_feature: GYAE6OF01AEGND.1.34.D01.1.454.CMB.1.raw
  modified_base (349)..(349): a, c, t, g, unknown or other
  misc_feature (349)..(349): n is a, c, g, or t
  modified_base (422)..(423): a, c, t, g, unknown or other
  misc_feature (422)..(423): n is a, c, g, or t
  modified_base (425)..(451): a, c, t, g, unknown or other
  misc_feature (425)..(451): n is a, c, g, or t
tcagacgagtgcgtcacgaccggtgctcgatttagatcgtctgtgttggggtttggggagtcaggccatcagtcgattctttagcctggttggtcgagccagaaacccaggggcgacgcccctcagtatcgtagtctatggtgcatccagattgcaaggtggggtcccatccaggttcagtggcagtgctatctgggacagtattacactctcactatcagcagcctgcaggcctgaagtattttgctaagttttacttactgtacaactagttattatacgtacccctagtggacgtttcggccagggggaccaaggtggaacgtcaaccgaactgtggctgcacctntcgtagtcttcgagttccgttcccgcctatctgaacgtctacctcgtctgagcgggctggcaaggcgcatagnngnnnnnnnnnnnnnnnnnnnnnnnnnnn

SEQ ID NO: 214095 - DNA, 539 bp, Homo sapiens
  misc_feature: GYAE6OF01BCFG6.1.34.D01.1.454.CMB.1.raw
  modified_base (280)..(280): a, c, t, g, unknown or other
  misc_feature (280)..(280): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctnagatcgtagtctatggtgcatccagattgcaagggtcgggtcccatccaggttcaggtggcagtgcagtcgtgggacagattacactctcactatcagcanccgggggtncgagcctagaagtattttagactaattttattactagtactaactagttaattactacgttaccccgtacggtcggtaccgttccgggaccgaggggtaccgtaaggggtacggaacggtacgaaccgtaacgtggtcggcgtgacccg

SEQ ID NO: 214096 - DNA, 382 bp, Homo sapiens
  misc_feature: GYAE6OF01C9OKF.1.34.D01.1.454.CMB.1.raw
  modified_base (378)..(382): a, c, t, g, unknown or other
  misc_feature (378)..(382): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaattttatactgtcaacagtattatagtacccctagtggacgttcggccaggggaccaaggtgaagtcaacgactgtggctgcacatctgtcttcatcttcccacctctcacgcactcgtctgagcgggctggcaaggcgcatagnnnnn

SEQ ID NO: 214097 - DNA, 489 bp, Homo sapiens
  misc_feature: GYAE6OF01AZ6BD.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagccccctcagatcgtagtctatggtgcatccagattgcaaggtgggtcccatccaggttcagtggcagtgcatctgggacagattacactctcactatcagcagcctgcagcctgaagtnttttgctaatttatactgtcaactagtattatagtaccctagtggacgttcggccaggggaccaagggtggaagtcgaacgactgtcggctgacc

SEQ ID NO: 214098 - DNA, 539 bp, Homo sapiens
  misc_feature: GYAE6OF01AEVQD.1.34.D01.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtatcagctgtgacatccaattgacccagtctccatccctcctgtctgcatctattgganacagagtcaccatcacttgccgggngagtcaggccatcagcgattctttagcctggttgcagcagaaaccagggcgacgcccctcagatcgtagtctagtggtgcatccagtattgcgtaaggtcggggtcccagtccgaggttcaggtggcagtgactatcgtgggacagtatacactctctactatcagacacgctgcagcctgaatatttnactaatttatacgttagtacaactagttattaacgttacgtacccgttacggtacggtaccgttcggaccggtagggtaccgtagggtaacggtaacgtacgaaaccggtaagtcggtcggtcgtacg

SEQ ID NO: 214099 - DNA, 577 bp, Homo sapiens
  misc_feature: GYAE6OF01EXF9N.1.34.D01.1.454.CMB.1.raw
  modified_base (369)..(369): a, c, t, g, unknown or other
  misc_feature (369)..(369): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgagcccctcagatcgtagtctatggtgcatccagtattgacaaggtgggtcccagtccaggttcagtggcagtgcatcgtggacagattacactcncactatcagcagcctgcagcctagaagtattttgactaagttttacttacgtagtaccaactagttaattaacgttaaccgttaaccccgttaacggttacgggtaacccggtttacgggaccccggtaagggggtaacccgtaaaggggttacggtaaacggtacccgtaaaacccggtaaacgttggtcgggtacgtcgtaacccg

SEQ ID NO: 214100 - DNA, 497 bp, Homo sapiens
  misc_feature: GYAE6OF01EDEGY.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggtcccatccaggttcagtggcagtgcatctgggacagattacactctcactatcagcagcctgcagcctagaagtattttgactaatttatactgtacaacagttattatacgtaccctagtgacgttcggaccaggggaccaagggtggaacgtacgaaccgaactggtcggctggacc

SEQ ID NO: 214101 - DNA, 542 bp, Homo sapiens
  misc_feature: GYAE6OF01DBV6X.1.34.D01.1.454.CMB.1.raw
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtggttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaaccattccacttgaccgggcagtcaggccatcagcgtattcttagcctggttgcagcagaacnggcagcccctnagctcgtagtctatggtncatccagtattgacaagggtcggtacccagttccgaggttcagtcggacagtgacagtcgtaggacagacttacacttctacactatacagacagtcctgaccagtcctagtaacgtattttcgacttaatttattacgtagtaccaaactagttaatacgtaacgttacccgtagtacggtacgttcggaccgtaggggacctaagggtacgaacgtacaacccgtatggtcgctcgaccg

SEQ ID NO: 214102 - DNA, 558 bp, Homo sapiens
  misc_feature: GYAE6OF01EDCLN.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattcttagcctggttgcagcaagaaaccngggcgacgcccctnagatcgtagtctagtggtgcatccagattgcgaagggtcgggtcccagtcccaggttcaggtcggcagtcgacagtcgtgggactagtaacttaccacttcgtactactatacgagccagcctgaccagtcctagaagttattttcgacttaaattttacttactgttaccaaagtgttaattactaccgttaacccctaggttcggtaaccggttcggacccgtaaggggacctaagggtaggaaacgtaccaaacggactggtcggtctgaccc

SEQ ID NO: 214103 - DNA, 513 bp, Homo sapiens
  misc_feature: GYAE6OF01ERBW1.1.34.D01.1.454.CMB.1.raw
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccagtccaggttcagtggcagtgcagtctgggacagattacactctacactatcagcagcctgcagcctgaagtnttttgactaatttattactgtacaactagttaattatacgtacccctagtcggacgttcgggaccgtaggggaccaagggtacggaacgtacgaaaccgtactggtacggctgaccg

SEQ ID NO: 214104 - DNA, 523 bp, Homo sapiens
  misc_feature: GYAE6OF01BNF9E.1.34.D01.1.454.CMB.1.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (516)..(516): a, c, t, g, unknown or other
  misc_feature (516)..(516): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttncagcagaaccgngggcgacgcccctcagatcgtatctatggtgacatccagtattgacgtaagggtcgggtccagtccgaggttcagtggctagtgctatcgagggacagattacactctactactatcagcaggcctgcagtcctagaacgttatttcgactaatttatactagtacaatagttaacttagtacgacccttagcggtacgttcggaccgaggggaccaagggttcgaagtaccaaacggtactggtacggntcggtac

SEQ ID NO: 214105 - DNA, 508 bp, Homo sapiens
  misc_feature: GYAE6OF01C6AXM.1.34.D01.1.454.CMB.1.raw
  modified_base (78)..(78): a, c, t, g, unknown or other
  misc_feature (78)..(78): n is a, c, g, or t
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggagtcagaccctgtcaggacncagcatggacatgagggtccccgctcagctcctgggctcctgctgctctggctcccaggtaccagctgtgacatccaattgacccagtctccatcctccctgtctgcatctattggagacagagtcaccatcacttgccgggnagtcaggccatcagcgtattctttagcctggttgcagcagaaaccagggcgagcccctcagatcgtagtctatggtgcatccagattgctaaggtcgggtcccatccaggttcaggtggcagtgcatcgtgggacagattacactctcactatcagcagcctgcacgcctaggaactattttgacttaattttattactgtacaatagttaattactacgtacccctagtcggtacgtcggaccgagggacctaagggacggaataccgaacgactggtcgctgacc

SEQ ID NO: 214106 - DNA, 538 bp, Homo sapiens
  misc_feature: GYAE6OF01CHRB8.1.34.D01.1.454.CMB.1.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagaatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcagaaaccngggcagcccctnagatcgtagtctagtggtgcatccagattgacgaagggtcggggtcccagtccgaggttcaggtggcagtgcatcgtgggacagtattacactctcactatcagcacgcctgcacgcctagaagtattttgacttaatttattactgtacaactagttaattatacgtaacccctaggtacggtacgttcggaccgtaggggtaaccaagggtaggaaacgtaccgaaaccggtaacgtcggtaggctggcctaaccg

SEQ ID NO: 214107 - DNA, 493 bp, Homo sapiens
  misc_feature: GYAE6OF01EZ4C1.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttatactgtacaactagttattatacgtacccctagttcggacgttcggccaggggaccaagggtggaagtcgaacgactgtggctgac

SEQ ID NO: 214108 - DNA, 637 bp, Homo sapiens
  misc_feature: GYAE6OF01B5QIV.1.34.D01.1.454.CMB.1.raw
  modified_base (284)..(284): a, c, t, g, unknown or other
  misc_feature (284)..(284): n is a, c, g, or t
  modified_base (422)..(422): a, c, t, g, unknown or other
  misc_feature (422)..(422): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcaagaaaccgagggcgacgcccctnagatcgtagtctatggtgcatccagattggacgtaaggggtcgggtacccagtccgtaggttcaggtggcagtgacagtcgtagggacagtacttacactctacactatcagcacgcctgacacgcctagtaacgttnttttagacttaaagttttacttaaccgttgttaaccaaacgttaagtttaactttacgttaaacccggttaacccccgttaacgggttacgggttaaaccccggtttccggggaacccggtaacggggggaaaccccgttaaagggggttacgggtaaaacggttacccgtaaaacccggttaaacggttcgggtacgggtcgtccgtaaacccg

SEQ ID NO: 214109 - DNA, 508 bp, Homo sapiens
  misc_feature: GYAE6OF01DAQL5.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccagtccaggttcagtggcagtgcatcgtgggacagattacactctcactatcagcagcctgcagcctagaagtattttgactaatttatactgtacaatattatatacgtacccctagtcggtacgttcggaccgaggggaccaagggtcggaaacgtccgaaaccggtactggtacggctggtacc

SEQ ID NO: 214110 - DNA, 516 bp, Homo sapiens
  misc_feature: GYAE6OF01D0IQK.1.34.D01.1.454.CMB.1.raw
  modified_base (281)..(281): a, c, t, g, unknown or other
  misc_feature (281)..(281): n is a, c, g, or t
  modified_base (442)..(442): a, c, t, g, unknown or other
  misc_feature (442)..(442): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggcgagtcaggccatcagcgattcttagcctggttgcagcagaaccagggcgagcccctnagatcgtagtctatggtgcatccagattggacaaggtgggtcccatccgaggttcagtggcagtgcatcgtgggactagattacactctcactatcaagcagcctgcagcctagaacgtattttgactaattttacgtacttgtacaactagttaacttanacgttaccctaggtcggacgttcggccgagggaccctaaggtcggaaagtcaaaccgtagtagtcggctgtacc

SEQ ID NO: 214111 - DNA, 486 bp, Homo sapiens
  misc_feature: GYAE6OF01EIXDT.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggccatccaggttcagtggcagtgcatctgggacagattacactctcactatcagcagcctgcagcctagaagtattttgctaatttattactgtactaactattattatacgtaccctagtggtacgttcggccagggaccaagataggaagtcaacgatggtgcgtcg

SEQ ID NO: 214112 - DNA, 527 bp, Homo sapiens
  misc_feature: GYAE6OF01AQ6ZM.1.34.D01.1.454.CMB.1.raw
  modified_base (268)..(268): a, c, t, g, unknown or other
  misc_feature (268)..(268): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcagcccctcagatcgtagtctatggtgcatccagattgcgaaggtcgggtcccatccgaggttcagtggcagtgcatctgggacagtattacactctcactatcagcagcctgcagcctagaagtnttttgacttaattttattactgtactaactagttaattactacgtaccccttaggtcggtaccgttccggaccgagggggaccaaggggtcggaaacgtccgaaaccggtactaggtcggcgttggaccc

SEQ ID NO: 214113 - DNA, 508 bp, Homo sapiens
  misc_feature: GYAE6OF01E400O.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (503)..(503): a, c, t, g, unknown or other
  misc_feature (503)..(503): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcacgcccctnagatcgtagtctatggtgcatccagtattgcgaagggtcgggtcccatccgaggttcaggtggcagtgcagtcgtgggacagtattacactctcactatcagcagcctgcagcctgaagtatttgacttaatttatactgtactaactagttattactacgtaccctaggtcggaccgttcggccgaggggacctaaggtggaagtcgaacgatagtcgtgngtacg

SEQ ID NO: 214114 - DNA, 608 bp, Homo sapiens
  misc_feature: GYAE6OF01CNJ0Q.1.34.D01.1.454.CMB.1.raw
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccggcgagtcaggccatcagcgtatttctttagccttggttgcagcaagaaaccgagggcgacgcccctcagatcgtagtctagtggtgcatccagattgcgaagggtcgggtcccatcccgtaggttcgagtggcagtgctagtcgtagggacagtattaacnctctcactatcagcagctgcagcctagaagtnttttagactttaaattttacttacgtacgttacaaacggtttatttaacgttaccgttaaccccggttaacggtttaccggtaccgggtttaccggtaacccgggtaaccgggggtaacgtaaacggggttacgggtaaacggtaacccgaaacccgtaaacggttacggtgggtaccgtaccgccgtaaacccg

SEQ ID NO: 214115 - DNA, 576 bp, Homo sapiens
  misc_feature: GYAE6OF01DU0NC.1.34.D01.1.454.CMB.1.raw
  modified_base (257)..(257): a, c, t, g, unknown or other
  misc_feature (257)..(257): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgacgaaggtcgggtcccagtccaggttcaggtggcagtgcagtcgtggacagattacactctacactatacacgacacgcctagccacgtcctagtaagttatttcgaactttaattttacttacgtagtaactaaagtatttaacttacttaccggttaaccctaggttcggtaccggtttaccggaccggtacgggaaccgtaggtaacggaacgtaccgaaacggtacgtggtcggtactcggtaccactacttcgttacgttccttactcttcccttcccctacccc

SEQ ID NO: 214116 - DNA, 388 bp, Homo sapiens
  misc_feature: GYAE6OF01B6HEZ.1.34.D01.1.454.CMB.1.raw
  modified_base (383)..(388): a, c, t, g, unknown or other
  misc_feature (383)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattatagtacccctagtggacgttcggccaggggaccaaggtgaagtcaacgaactgtgctgcaccatctgtcttcatcttcccgccctctcacgcactcgtctgagcgggctggcaaggcgcatacgnnnnnn

SEQ ID NO: 214117 - DNA, 384 bp, Homo sapiens
  misc_feature: GYAE6OF01EDESQ.1.34.D01.1.454.CMB.1.raw
  modified_base (379)..(384): a, c, t, g, unknown or other
  misc_feature (379)..(384): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaattttattactgtcaacagtattatagtaccctagtggacgttcggccaggggaccaaggtggaagtcaaccgactgtggctgcacatctgtcttcatctcccgcctctcacgcactcgtctgagcgggctggcaaggcacatagnnnnnn

SEQ ID NO: 214118 - DNA, 505 bp, Homo sapiens
  misc_feature: GYAE6OF01BOD1E.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctnagatcgtagtctatggtgcatccagattgcaagggtcgggtcccatccgaggttcaggtggcagtgcatcgtgggacagattacactctcatatcagcacgcctgcacgcctagaagtattttgactaatttattactgtacaactagttattactacgtaccctagtcggtacgtcggcgagggactagggtaggaacgtccgaacgaacgtggtcgcgtgacc

SEQ ID NO: 214119 - DNA, 526 bp, Homo sapiens
  misc_feature: GYAE6OF01BY6IF.1.34.D01.1.454.CMB.1.raw
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcgagcccctcagatcgtagtctatggtgcatccagattgcaaggtgggtcccatccaggttcagtggcagtgcatcgtgggacagattacactctcactatcagcagcctgcagcctagaagtntttgactaatttattactgtacaatagttattatacgtaccccttagtcggtaccgttcggccgtagggggaccctaagggtacggaaaggtaccgtaaacccggtaacttggtacgggccttggacccg

SEQ ID NO: 214120 - DNA, 603 bp, Homo sapiens
  misc_feature: GYAE6OF01A7LHY.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcactccagtattggcgaaggggtcgggtcccatccgaggttcaggtcggcaggtcgctagtcgtgggacagtacttaccgactctacactatcgacgcacgcctgacacgtccgtagaagttacttttagactttaaattttacttacgttacgtaactaacgttaagttaatttaacgtaacccgttaaccccgttaggtacgggttacccggtttaccggaccgggtaacggggtaaccgtaaaggggtacggtaaaccgtacccgtaaaccggtaacgttggtacggtccgtggtaacccc

SEQ ID NO: 214121 - DNA, 555 bp, Homo sapiens
  misc_feature: GYAE6OF01BZO4B.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccagggcgagcccctnagatcgtagtctatggtgcatccagattgcaagggtcgggtcccatccgaggttcagtggcagtgctagtcgtgggacagattacactctcactatcagcagcctgcagcctgaagtattttgactaattttaacttactgtacaactagttaattagtaaccgttacccctaggtcggtaaccggttccgggaccggtaacggggaaccgtaaggggttacggaaacggttaccgtaaaccggtaacgttaggtacgggtcgtcggtacccg

SEQ ID NO: 214122 - DNA, 501 bp, Homo sapiens
  misc_feature: GYAE6OF01EJDKW.1.34.D01.1.454.CMB.1.raw
  modified_base (393)..(393): a, c, t, g, unknown or other
  misc_feature (393)..(393): n is a, c, g, or t
  modified_base (494)..(494): a, c, t, g, unknown or other
  misc_feature (494)..(494): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgcaaggtcgggtccatccaggttcagtggcagtgcatctgggacagattacactctcactatcagcagcctgcagcctgaatntttgactaatttatactgtacaactagtattatacgtaccctagtggaccgttcggaccgaggggaccaagggtggaagtacctaaccggaactggtacgngtgaccg

SEQ ID NO: 214123 - DNA, 601 bp, Homo sapiens
  misc_feature: GYAE6OF01A9SE8.1.34.D01.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcgagcgtattctttagactggttgcagcaagaaaccgagggcgacgcccctanagactcgtagtctagtggtgcataccagtattggacgaagggtcggggtaccctagtccgaggttcaggtcggcagtgctagtcgtagggacagtacttacactctacactatcgagcacgcctgcacgtccgtagtaacgttatttcgaacttaattttattacgtacgttactaacgtagttaacttacgtaaccgttacccgtacggttacggtaccggttacgggacccgtaacgggggaacccgtaaaggggtacgggtaaaccgtaaccgaaacccggttaacgttgggacggtccgttcggaacccg

SEQ ID NO: 214124 - DNA, 514 bp, Homo sapiens
  misc_feature: GYAE6OF01B50BH.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgacgcccctnagatcgtagtctatggtgcatccagattgcgaaggtcgggtcccagtccaggttcagtggcagtgctatcgagggacaggtattacacttctacactatcagcagcctgcagcctgaatatttgactaattttatactgtacaactagttattactaacgtacccctagtcggtacgttccgggctaggggacctaagggtcggaaatcgaaccggtatggtcgctgacccg

SEQ ID NO: 214125 - DNA, 563 bp, Homo sapiens
  misc_feature: GYAE6OF01D9YXB.1.34.D01.1.454.CMB.1.raw
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcaggccatcagcgtattctttagcctggttgcagcaagaaacccngggccgacgcccctnagatcgtagtctagtggtncatccagtattgcgtaaggggtcgggtcccatccgaggttcaggtggcaggtgctagtcgtgggacagtacttacactctcactatcagcacgcctgcagtcctaggaagttatttcgacttaattttacttactgtacaactagttaattagtaaccgttaccccgtaggtcggtaaccggttccgggacccgtaggggaacccgtaagggtacgggtaaacgtaccgtaaaccggtaactaggtcggtctcgacc

SEQ ID NO: 214126 - DNA, 520 bp, Homo sapiens
  misc_feature: GYAE6OF01DYY6Q.1.34.D01.1.454.CMB.1.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccagggcgagcccctnagatcgtagtctatggtgcatccagattgcgaagggtcgggtcccagtcccaggttcagtggcagtgcatcgtgggacagattacactctcactatcagcagcctgcagtcctagaatnttttgacttaattttattactgtacaactagttaattactacgtaccctaggtacggtacgttcggaccgaggggacctaagggtggaacgtaccgaaaccgacgtggtcggcgtgaccg

SEQ ID NO: 214127 - DNA, 533 bp, Homo sapiens
  misc_feature: GYAE6OF01CYQNS.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctatggtgcatccagattgcaaggtgggtcccatccaggttcagtggcagtgcatctgggacagattacactctcactatcagcagcctgcacgcctagaacgtattttgactaattttaattacgtgtactaacgtagttaattacttaacgtacccctaggtcggtaccggttccgggaccgaagggggaacctaaaggggtcggaaagtaccgaaaccggtaactggtacggctggacc

SEQ ID NO: 214128 - DNA, 515 bp, Homo sapiens
  misc_feature: GYAE6OF01ANI6P.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaaccagggcgagcccctnagatcgtagtctatggtgcatccagattgcaaggtcgggtcccatccgaggttcaggtggcaggtgcagtcgtgggacagtattacacttctcactatcagcagcctgcagcctgaactatttgataatttattactgtactaatagttacttatacgtacccctaggtcggtacgttaccggccgaggggaccaagggttacggaacgtacaaaccgtatggtcggctggcc

SEQ ID NO: 214129 - DNA, 585 bp, Homo sapiens
  misc_feature: GYAE6OF01CXTQP.1.34.D01.1.454.CMB.1.raw
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcagtcaggcatcagcgattctttagctggtgcagcagaaccagggcgacgcccctnagatcgtagtctagtggtgcatccagattgctaagggtcgggtacccagtccgaggtttcaagtggacagtgactagtcgtagggacagtacttacactctacactatacagcagcctgcagtcctagtaagttatttagacttaaagttttacttaacgtcgtaactaaacttacgttaatttaacgtaaccgttacccgtaacggtccggtaaccggttaccgggaccggtaacgggggtaaccgtaaagggttacgggtaaaacgttacccgtaaaccgtaacgttggtacggcctaggtaacccg

SEQ ID NO: 214130 - DNA, 545 bp, Homo sapiens
  misc_feature: GYAE6OF01CJX83.1.34.D01.1.454.CMB.1.raw
  modified_base (221)..(221): a, c, t, g, unknown or other
  misc_feature (221)..(221): n is a, c, g, or t
  modified_base (282)..(282): a, c, t, g, unknown or other
  misc_feature (282)..(282): n is a, c, g, or t
  modified_base (419)..(419): a, c, t, g, unknown or other
  misc_feature (419)..(419): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggngagtcaggccatcagcgattcttagcctggttgcagcaagaaaccagggcgacgcccctanagactcgtagtctagtggtgcatccagtattcgacgaagggtcgggtcccagtccgaggttcaggtcggcagtgcagtcgtaggactagacttacacttctactactactcgagcagtcctagcagcctagtaagtntttgacttaatttattactagtacaaactagttaattacgacgtacccttaggtacggtacgttcggaccgaaggggacctaagggtacgaaacgtcgaaaccggtaagtggtacgcgtacggacc

SEQ ID NO: 214131 - DNA, 505 bp, Homo sapiens
  misc_feature: GYAE6OF01AZNAS.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctagtggtgcatccagatttgcaaggtcgggtcccatccaggttcagtggcagtgcatctgggacagattacactctcacttatcgagcagcctggccagcctgaacgtattttgactaattttatactgtactaacagttattactacgtacccctagtcggaccgttcggccgagggaccaagggtggaacgtcaaccgactggcgctgtacc

SEQ ID NO: 214132 - DNA, 636 bp, Homo sapiens
  misc_feature: GYAE6OF01BTLZT.1.34.D01.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttgccggcgagtcaggccatcagcgtattctttagcctggttgcagcaagaaaccgagggcgacgcccctnagatcgtagtctatggtncatccagtattgacgaagggtcgggtccagtccgtaggttcaggtggcaggtgctagtcgagggacagtacgttaccacttccgtacacttactcagcacgtcctgccacggtacctaggtaaacgttattttacgaccttaaagttttaacttacgtcgttaacctaaacgttacgtttaactttacgtaaccggtttaaccccctacgggtttaccgggtaacccggtttccgggaacccggtaagggggaacccgtaaaggggttaccgggtaaacggttaacccgtaaacccgggttaaacggttcggtacgggcccgttaggtaacccg

SEQ ID NO: 214133 - DNA, 391 bp, Homo sapiens
  misc_feature: GYAE6OF01C5CZZ.1.34.D01.1.454.CMB.1.raw
  modified_base (387)..(391): a, c, t, g, unknown or other
  misc_feature (387)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaactagtattatagtacccctagtggacgttcggccaggggaccaaggtggaatcaaccgaactgtggactgcaccatctagtcttcatccttcccaccctctcacgcactcgtctgacgcgggctggcaaggcgcatagnnnnn

SEQ ID NO: 214134 - DNA, 535 bp, Homo sapiens
  misc_feature: GYAE6OF01CPX9Z.1.34.D01.1.454.CMB.1.raw
  modified_base (255)..(255): a, c, t, g, unknown or other
  misc_feature (255)..(255): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggtgcagcagaaaccagggcgagcccctnagatcgtagtctatggtgcatccagattgacaagggtcggggtcccatccgaggttcagtggcagtgcatcgtgggacagtattacactctcactatcagcagcctgcagcctagaagtattttgacttaatttattactgtacaactagtattactacgtaacccctagtcggtacgttcggaccgaggggaccgagggtaggtaacgtacgaaaccgaacgttggtacggtacgtcgaccaccgtatccgttcgtacttcaacttccgttccccgacc

SEQ ID NO: 214135 - DNA, 492 bp, Homo sapiens
  misc_feature: GYAE6OF01AYXOH.1.34.D01.1.454.CMB.1.raw
  modified_base (486)..(486): a, c, t, g, unknown or other
  misc_feature (486)..(486): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtactaacagtattatacgtaccctagtcgacgttcggccgtagggaccaggtggaagtacgaacgaactgacgngtgacc

SEQ ID NO: 214136 - DNA, 402 bp, Homo sapiens
  misc_feature: GYAE6OF01B8413.1.34.D01.1.454.CMB.1.raw
  modified_base (394)..(402): a, c, t, g, unknown or other
  misc_feature (394)..(402): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgctaattttattactgttcaatagtattatacgtacccctaggtcggacgtttcggcctaggggaccaaggtggaagtcaaccgaactgtggctgcaccatctgtcttcatcttcccgcatctgaactcactcgtctgagcgggctggacaaggcgcaatagnnnnnnnnn

SEQ ID NO: 214137 - DNA, 394 bp, Homo sapiens
  misc_feature: GYAE6OF01DOTGC.1.34.D01.1.454.CMB.1.raw
  modified_base (380)..(380): a, c, t, g, unknown or other
  misc_feature (380)..(380): n is a, c, g, or t
  modified_base (387)..(394): a, c, t, g, unknown or other
  misc_feature (387)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggcagggggaccaaggtggaagtcaaccgaactgtggctgcaccatctgtcttcatcttcccgcatctgaacgcactcgtctgagcgggctgggcaagggcncaatagnnnnnnnn

SEQ ID NO: 214138 - DNA, 551 bp, Homo sapiens
  misc_feature: GYAE6OF01DJ358.1.34.D01.1.454.CMB.1.raw
  modified_base (255)..(255): a, c, t, g, unknown or other
  misc_feature (255)..(255): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttncagcagaaccagggcgagcccctcagatcgtagtctatggtgcatccagattgcaaggtcgggtccagtccaggttcagtggcagtgctatcgtgggacaggtattacacttacncactatcagcagccctgccaggcctaggtaagttacttttagacctttaaattttactacttacgtactaaacgtagttaatttacgtaacgttacccctaggtcgtacggtttcggaccgtaaggggacctaagggtacggaaacgttacgaaaccggtaacgttggtacggcgtggacc

SEQ ID NO: 214139 - DNA, 557 bp, Homo sapiens
  misc_feature: GYAE6OF01B5ZZP.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggtgcagcagaaaccagggcgagcccctcagatcgtagtctatggtgcatccagattgcgtaagggtcgggtcccatccaggttcagtggcagtgcagtcgtgggacagattacactcacactatcagcagcctgacagcctagaaacgtattttgacttaattttacttactacgtacaacgtagttaatttactacgttaacccctaggttacggaccggtttcggaccgaaggggtaccaaaggggtcgaaacggttaccaaaccggtaactggtacggcctaggaccaccgtagttccgttagttccttacacttcccgttccgaccg

SEQ ID NO: 214140 - DNA, 533 bp, Homo sapiens
  misc_feature: GYAE6OF01EOF8O.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcaagggtcgggtcccagtcccaggttcaggtggcagtgcatcgtgggacagtattacactctcactatcagcacgcctgcacgcctgaagtattttgacttaatttattactgtacaactagttattactacgtacccctaggtcggtaccggttcggaccgtagggggaccaagggttacggaagtaccgaaaccggaacgttaggtcggtcgtggacccg

SEQ ID NO: 214141 - DNA, 386 bp, Homo sapiens
  misc_feature: GYAE6OF01D2XTJ.1.34.D01.1.454.CMB.1.raw
  modified_base (377)..(377): a, c, t, g, unknown or other
  misc_feature (377)..(377): n is a, c, g, or t
  modified_base (383)..(386): a, c, t, g, unknown or other
  misc_feature (383)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtaccctagtggacgttcggccaggggaccaaggtggaagtcaaccgaactgtggctgcaccatctgtcttcatcttcccgcatctgaacgcactcgtctgagcgggctggcaaggcncatagnnnn

SEQ ID NO: 214142 - DNA, 575 bp, Homo sapiens
  misc_feature: GYAE6OF01DQ2SF.1.34.D01.1.454.CMB.1.raw
  modified_base (302)..(302): a, c, t, g, unknown or other
  misc_feature (302)..(302): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcaagaaaccgagggcgacgcccctcagatcgtagtctatggtncatcagattgacgaagggtcgggtcccagtccgaggttcagtcggcagtgcagtcgtgggacagtacttacactctacactatcagcagcctgcacgcctagtaagtnttttgacttaattttatacttagtacaactagttaacttacgtaaccgttaccccgttaggtacggtaccggtttaccgggacccggtaagggggtaaccctaaggggtacggtaaacgtacccgtaaacccggtaacgttagggttaccggcgttcggaacccc

SEQ ID NO: 214143 - DNA, 506 bp, Homo sapiens
  misc_feature: GYAE6OF01BT82J.1.34.D01.1.454.CMB.1.raw
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggcgagtcaggccatcagcgattcttagcctggttgcagcagaaaccngggcagcccctnagatcgtagtctatggtgcatccagtattgcaagggtcgggtcccatccaggttcaggtggcagtgcatcgtagggacagtattacactctcactatcagcagcctgcagcctagaagtnttttgactaattttatactgtacaactagttattataacgtaccctagtcggtacgttcggaccgaggggacctaagggtgaacgtcgaaccgactgtcggctgacc

SEQ ID NO: 214144 - DNA, 975 bp, Homo sapiens
  misc_feature: GYAE6OF01C3ZWC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctagtggagacagagtcaccatcacttcggccgggcgagtcacggccatcagcgtattctttagccttggttgcacgcaacgaaaccgagggccgacgccccctcaagatcgtagtctagtggtgactataccagtattggacgtaaggggttccgggtacccctacgttcccgtaagggtttccgaaggttcgggaccgtaaggttcggacgtacgtttaccgggttagggggaacctaagggttaacctttaacccgacccgttttaccgttaaccctaaaccgtttaacgttacccgaacggttaccccgaaccggggtccccctttaggggaccccgttaaaccgggtacccccggtttaagggttaaaaacggtttttaaccggtttttttttacgggaaaccccgttttttaaaaatttttttttaaaccgtttttaacccgtttaacggggtttaaacccctaaaaaccggtttaaacgggttttttaaaaccttttttaacccgggtttaaaacccccgggtttttaaaacccccccccgggtttaaacgggggttttacccgggggttttaaaacccccgggggtttttacccccgggggggtaaaccccccggggttaaaacgggggggggggtaaaacccccgtttaaaagggggggggtttaaaccccggggttaaaaaaacccgggtttccccggaaaaaaaaccccccggggttttacggtttagggggtttaaccccggggtaccccgtttaccggggtaaaacccccccg

SEQ ID NO: 214145 - DNA, 391 bp, Homo sapiens
  misc_feature: GYAE6OF01DI5C5.1.34.D01.1.454.CMB.1.raw
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctacgtggaacgttcggccaggggaccaaaggtggaaagtcaaccgaaactgtggctgcaccatctgtcttcatcttcccgcccatctgaacgcactcgtctgagcgggctggccaaaggcgcatagn

SEQ ID NO: 214146 - DNA, 420 bp, Homo sapiens
  misc_feature: GYAE6OF01CMN1X.1.34.D01.1.454.CMB.1.raw
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (402)..(420): a, c, t, g, unknown or other
  misc_feature (402)..(420): n is a, c, g, or t
tcagacgagtgcgtcacgaccggtgctcgatttagatcgtctgtgttggggttttggagtcaggccatcagcgattctttagcctggttgcagcagaaaccgagggcggagccctcagactcgtagtctatggtgacatccagattggcgtaagggtgggggtcccaagtcccaggttcagtggcagtgcatctgggacagattacactctcactatcagcagcctgccagcctagaagattttgactaatttattactgtacaacgagtattaatacgttaccctagttggacgttcggcccagggggaccaagggtgaaagtcaaccgactgngctgcacntctgtctnatcttcccgcatctgaacncactcgtctgagcgggctggcaggcgcatagnnnnnnnnnnnnnnnnnnn

SEQ ID NO: 214147 - DNA, 505 bp, Homo sapiens
  misc_feature: GYAE6OF01C6WQF.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatctgggacagattacactctcactatcagcagcctgcagcctgaagtattttgactaatttattactgtacaactagttattatacgtacccctagtcggtacgttcggccgaggggaccaagggtacggaagtacgaaaccgaacttggtacggctgacc

SEQ ID NO: 214148 - DNA, 713 bp, Homo sapiens
  misc_feature: GYAE6OF01BPQYZ.1.34.D01.1.454.CMB.1.raw
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaagaaaccgagggccgacgcccctnagatcgtagtctagtggtncatccagattggacgaagggtcgggtacccagtcccgtaggttcgaggtcggactagtgactagtcgtagggaactacgtaacttaccacttacctaccaacttactaccgaagcctaacggtccctaggaccgtacggtacccgttaagggtaaacgtttactttttacgggaaccttttaaagttttaacgtttaccgtacggtttaaccctaaacgtttaacgttaaactttaaccgttaaacccgggttaaccccccgtttaagggttaccgggtaaaccccgggttttccgggaaccccgggttaaacggggggtaaacccggtaaaggggttaccgggtaaaaccggttacccgtaaaacccggttaaaccggttacggtaccgggtaccgttccgaaacccg

SEQ ID NO: 214149 - DNA, 511 bp, Homo sapiens
  misc_feature: GYAE6OF01B3HKX.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaaccagggcgacgcccctcagatcgtagtctatggtgcatccagattgcaaggtggtccatcgagttcagtggcagtgcatcgtgggacagtattacactctacatactcagcagcctagcagcctagaagtatttgacttaatttacttactgtacaatagttattatacgtaccctagtcggacgttcggaccgtaggggaccgtaaggtcggaaacgtacgaaccgtaagtgtcggtcgtgacc

SEQ ID NO: 214150 - DNA, 582 bp, Homo sapiens
  misc_feature: GYAE6OF01ECBYR.1.34.D01.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcaagaaaccaggggccgacgcccctnagatcgtagtctatggtgcatccagtatttgacgaagggtcgggtcccatccgaggttcaggtggcagtgcatcgtgggacagattacactctacacttatacagcagccctgcacgtcctagaacgttattttcgacttaaattttactttaacgtgtaacctaaacgtagttaatttactaacggttaaccccctaggttacgggacggtttccggaccggtaaggggtaacccgaagggttacgggaaacgttacccgaaaccggtaacgttacggtagggtcctggtaacccg

SEQ ID NO: 214151 - DNA, 566 bp, Homo sapiens
  misc_feature: GYAE6OF01ARN4W.1.34.D01.1.454.CMB.1.raw
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
  modified_base (540)..(540): a, c, t, g, unknown or other
  misc_feature (540)..(540): n is a, c, g, or t
  modified_base (547)..(548): a, c, t, g, unknown or other
  misc_feature (547)..(548): n is a, c, g, or t
  modified_base (551)..(552): a, c, t, g, unknown or other
  misc_feature (551)..(552): n is a, c, g, or t
  modified_base (556)..(566): a, c, t, g, unknown or other
  misc_feature (556)..(566): n is a, c, g, or t
tcagacgagtgcgtcacgaccggtgctcgatttagatcgtctgtgttgggtttgggtaggtcaggccatcagcgattctttagtcctggttgtcagcagaaaccgacgggcggagccctccagatcgtagtctatggtgcatccagattgcaaggtggggtcccatccaggttcagtggcagtgcatctggggacagattacactctcactatcagcagcctgcagcctgaagatttttcgactaattttattactgttacaacctagtactttatactaccccctaggtggacgttcggtcccgagggggacgaacggtggaagttaccaaccgtaaacctggttagggctcgacaccgatctagttccgttcaacttccgttccccgtccacttacgttcggaaaccgtccgaccctttaccggttcgttagggaccggtacggggccccggtagggtaccgaacgggaccgcgtaactaagggtccngtcaggctagcncgangtnaaacngacngtcagctnctgaaacctgatcncgtaaannctnnaacnnnnnnnnnnn

SEQ ID NO: 214152 - DNA, 388 bp, Homo sapiens
  misc_feature: GYAE6OF01B1W8F.1.34.D01.1.454.CMB.1.raw
  modified_base (383)..(388): a, c, t, g, unknown or other
  misc_feature (383)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgaactgtggctgcaccatctgtcttcatcttcccgccatctgaacgcactcgtctgagcgggctggcaaggcgcatagnnnnnn

SEQ ID NO: 214153 - DNA, 516 bp, Homo sapiens
  misc_feature: GYAE6OF01ED00S.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccatctgtgacatccaattgacccagtctccatcctccctgtctgcatctattggagacagagtcaccatcacttgccgggcgagtcaggccatcagcgattctttagcctggttgcagcagaaaccngggcgagcccctcagatcgtagtctatggtgcatcagattgcaaggtgggccagtcctaggttcagtggcagtgcatcgtgggacagattacactctcactatcagcacgcctgccagcctagaagtatttgctaatttatactgtacaactagttattatacgtaccctagtcggtacgttccggaccgtaggggacctaagggtaggtaaacgtaccgtaaaccgaacgtggtacggctggtaccc

SEQ ID NO: 214154 - DNA, 490 bp, Homo sapiens
  misc_feature: GYAE6OF01EFXH8.1.34.D01.1.454.CMB.1.raw
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtgcagtgcatcgtgggacagattacactctcactatcagcagcctgcagcctagaagtattttgacttaatttattactgtacaatagtattatacttaccctagtcggacgttcggcgagggaccaaggtggaagtacaacgactgngcgtgacc

SEQ ID NO: 214155 - DNA, 520 bp, Homo sapiens
  misc_feature: GYAE6OF01BCXQ9.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctagtggtgcatccagattgacaaggtcgggtccagtccaggttcaggtggcagtgcagtcgtgggacagattacactctcatatcagcagcctgcagcctagaactattttgacttaattttatacgtgtacaactagttattatacgtaccctagtcggtacgttcggccgtaaggggaccctaagggtcgaaacgtaccgaaaccgtactggtacggtcgtgaccg

SEQ ID NO: 214156 - DNA, 525 bp, Homo sapiens
  misc_feature: GYAE6OF01DSHO9.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctatggtgcatccagattggcaaggtcgggtcccatccgaggttcaggtggcagtcgcatctgggactagattacactctacactatcagcagcctgcagctagaatntttgactaatttatactgtacaactattattatacgtaccctagtcggtacgttccggaccgtaaggggacctaagggtacgggtaaacgtaccgaaaccgggtaacttgggacggccgtgacccg

SEQ ID NO: 214157 - DNA, 521 bp, Homo sapiens
  misc_feature: GYAE6OF01EKVFL.1.34.D01.1.454.CMB.1.raw
  modified_base (279)..(279): a, c, t, g, unknown or other
  misc_feature (279)..(279): n is a, c, g, or t
  modified_base (514)..(514): a, c, t, g, unknown or other
  misc_feature (514)..(514): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctagtggtgcatccagtattgacgtaagggtcgggtcccaagtcccgaaggtttccaaggttgggcaggtgcatcgtgggaacagtattacactctacactatcagcacgtcctgacagccctagaagttattttgacttaatttatacgtgtacaactgttaattactacgtaccctaggtcggtacgttcggaccgagggaccagggtagagtacacgaatgngctgacc

SEQ ID NO: 214158 - DNA, 568 bp, Homo sapiens
  misc_feature: GYAE6OF01COFA7.1.34.D01.1.454.CMB.1.raw
  modified_base (365)..(365): a, c, t, g, unknown or other
  misc_feature (365)..(365): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggtgcagacaagaaaccgagggcgagcccctcgagatcgtagtctagtggtcgcatccagtattgacgaaggggtcgggtcccagtccgaggttcaggtggcagtgcatcgtgggacagtattacactctacacttancagcacgcctgcagtcctagtaagtatttagacttaatttattactgtactaactagttaattacgtacgttacccgtaggtcggtaaccggttcggaaccggtagggaaccgtaagggtacgggaactaccgaaaccggagttgggtcggatacggtacaccgtagtttctacggttcttacgtacttcccgttcccgaccg

SEQ ID NO: 214159 - DNA, 525 bp, Homo sapiens
  misc_feature: GYAE6OF01A0JXQ.1.34.D01.1.454.CMB.1.raw
  modified_base (279)..(279): a, c, t, g, unknown or other
  misc_feature (279)..(279): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcagtcaggccatcagcgattctttagcctggttgcagcagaaaccagggcgagcccctnagatcgtagtctatggtgcatccagattgcaaggtgggtcccatccaggttcaggtgcagtgcatcgtgggacagattacactctcactatcagcagctgcagcctagagtntttgacttaatttacttacgtgtactaactagttaacttatacgttaccctagttcggacgttccggccgaggggtaacctaacgggtacggtaacgtaccgtaaaccggtaacttaggtacggcgtgtacccg

SEQ ID NO: 214160 - DNA, 561 bp, Homo sapiens
  misc_feature: GYAE6OF01COC7X.1.34.D01.1.454.CMB.1.raw
  modified_base (271)..(271): a, c, t, g, unknown or other
  misc_feature (271)..(271): n is a, c, g, or t
  modified_base (555)..(555): a, c, t, g, unknown or other
  misc_feature (555)..(555): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcaagaaaccngggcgagcccctacagatcgtagtctatggtgcatccagtattcgacgaagggttcgggtacccaattcccgaaggtttcaaggttcgggactaggtgacgtattccgtaggggaacaggtaacttacacttcctacaacttatcaagtcagcctgcgagtcctaggtaagtatttagacttaatttaattactagtacaactagttaattacttacgtacccctaggtacgtacggttcggaccgaaggggaccaaggtaggaactacgaaacgacgtgtcgntgaccg

SEQ ID NO: 214161 - DNA, 514 bp, Homo sapiens
  misc_feature: GYAE6OF01BGTDY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaagggtcgggtcccatccgaggttcaggtggcagtgcagtcgtgggacagtattacactctcactatcagcacgcctgcagcctagaagtatttgacttaatttattactgtacaactagttattatacgtaccctaggtacggtaccgttcggccgtaagggaccgaaggtaggaagtaccgaacgactaggtggcgtgaccg

SEQ ID NO: 214162 - DNA, 579 bp, Homo sapiens
  misc_feature: GYAE6OF01B4LB4.1.34.D01.1.454.CMB.1.raw
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctagtggtgcatccagattgctaagggtcggtccatccgaggttcagtgcagtncatcgtagggacagtattacactctacactatcagcacgcctgccagtcctagtaagtattttcgacttaattttacttactagttaccaaagtagtttactttacgtaaccgttaccccgtaacggttacggtaccggtttaccgggacccggaagggggtaacccgtaaaggggttagggaaaccggttaccgtaaaacccgggtaacttagggtcggtccgtcggaacccg

SEQ ID NO: 214163 - DNA, 559 bp, Homo sapiens
  misc_feature: GYAE6OF01B0RP2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcgaagggtcgggtcccatccgaggttcaggtggcagtgcatcgtgggacagattacactctcactatcagcagcctgcagcctagaagtattttgactaattttattacgtgttacaactagttaattacttaaccgttaccccgttaaggttcggtaccggtttccgggacccgtaagggggaaccccgtaaggggtacgggtaaacggtaccgaaaccggtaacgttaggtacggtcgtcggacccg

SEQ ID NO: 214164 - DNA, 389 bp, Homo sapiens
  misc_feature: GYAE6OF01B2I9E.1.34.D01.1.454.CMB.1.raw
  modified_base (383)..(389): a, c, t, g, unknown or other
  misc_feature (383)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctacgtggacgttcggccagggggaccaaggtggaagtcaacgaactgtggctgcaccatctgtcttcatcttcccgcatctgaacgcactcgtctgagcgggctggcaaggcgcatagnnnnnnn

SEQ ID NO: 214165 - DNA, 508 bp, Homo sapiens
  misc_feature: GYAE6OF01AK4N2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcgaaggtgggtcccagtccaggttcagtgcagtgcatctgggacagattacactctcactatcagcagcctgcagcctagaacgtattttgtaattttattactgtactaactagttattatacgtaccctagtcggtacgttcggccgtagggtaccagggtcgaagtacgaaccgtaactggtaggctgcgtaaccg

SEQ ID NO: 214166 - DNA, 386 bp, Homo sapiens
  misc_feature: GYAE6OF01DGAF9.1.34.D01.1.454.CMB.1.raw
  modified_base (382)..(386): a, c, t, g, unknown or other
  misc_feature (382)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccctagtggacgttcggccagggggaccaaggtggaagtcaaccgaactgtggctgcacatctgtcttcatcttcccgcatctgaacgcactcgtctgagcgggctggcaaggcgcatagnnnnn

SEQ ID NO: 214167 - DNA, 552 bp, Homo sapiens
  misc_feature: GYAE6OF01EXV6S.1.34.D01.1.454.CMB.1.raw
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcgacggccatcagcgatttcttagccgtggttgcagcaagaaaccgagggcgacgcccctgagatcgtagtctagtggtgcatccgagtattcgacgtaagggtcgggtacccagtcccgtaggttcaggtcggctaggtcgcatcgtagggacagtacttacgactctcactactcagcacgcctgcagcctagaagttnttgactaatttatactgtacaactagttatataccgtaccgtagtcggacgttccggaccgtaggggaaccgtagggtacgtaaggtacccgtaaaccggtacgtggtcggtcgtcgtaacccg

SEQ ID NO: 214168 - DNA, 512 bp, Homo sapiens
  misc_feature: GYAE6OF01BRKA0.1.34.D01.1.454.CMB.1.raw
  modified_base (280)..(280): a, c, t, g, unknown or other
  misc_feature (280)..(280): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcacgcccctnagatcgtagtctatggtgcatccagattgcaaggtcgggtcccatcctaggttcagtggcagtgcatcgtgggacagtatacactctcactatcagcagcctgcagcctgtaacgtnttttagactaatttattactgtacaactagttattactacgtaccctaggttcggtacgttcggaccgtaggggacctaagggtacggaacgtacgaacgacgtgcggctggacc

SEQ ID NO: 214169 - DNA, 611 bp, Homo sapiens
  misc_feature: GYAE6OF01C2BM4.1.34.D01.1.454.CMB.1.raw
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctatggagacagagtcaccatcacgttgccgggcgagtcaggccatcagcgtattcttagcctggtncagcaagaaccgagggcgacgcccctnagatcgtagtctagtggtgcatccgagagttcgacgtaaggggtcgggtcccagtccgaggttcaggtggcagtcgacagtcgtgggacagtactacactctacactatcagcacgtcctgcacgctagtaacttatttgacttaatttactactcgtactaaacgttagttaacttaacgtaaccgtaaccccttaagggtaccggttaaccggttaccgggaaccggtaacggggtaaaccgtaggggttaacggaaacgttaccgaaaccggtagtacgggtcggtaccgttacggaccctaaccgtgttccgttacggttaccttacgtaaccttcccggttccccgaac

SEQ ID NO: 214170 - DNA, 649 bp, Homo sapiens
  misc_feature: GYAE6OF01CCD9P.1.34.D01.1.454.CMB.1.raw
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (378)..(378): a, c, t, g, unknown or other
  misc_feature (378)..(378): n is a, c, g, or t
  modified_base (457)..(457): a, c, t, g, unknown or other
  misc_feature (457)..(457): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctatggagacagagtcaccatcacttgccgggnagtcaggccatcgagcgtatttcgtttagccgttggttgcagcaaggaaaccnggggcacgcccctanagactcgtatctagtggtgcattccgagtattcggacgtaacggggtcgggtaccccagttacccgaggttcgaggtggaccaggtcnctagtcgtagggacaggtacttacacgtacctacgaactatacacggcacggccctgacacgtaccctaggtaaacgtntttttaacggactttaaatttttacttaaccttacggttaacctaaacgttaagttttaacttaacgttaacccgtaccccgttaagggtcggtaaccggtttaccgggaccgaaggggggtaaccctaaaggggttacggaaaacggtaccgtaaaccggtaaccggttggtacgggtcctgggtaacccc

SEQ ID NO: 214171 - DNA, 509 bp, Homo sapiens
  misc_feature: GYAE6OF01BEGSZ.1.34.D01.1.454.CMB.1.raw
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctcagatcgtagtctatggtncatccagattgcaagggtcgggtcccatcccgaggttcagtggcagtgcatctgggacaggattacactcncactatcagcagcctgcagcctagaagtnttttgacttaaatttattactagtactaactagttattatacgtaccctagtcggacgttcggccgtagggacctagggtagaacgtcaaaccggatggtcggctggacc

SEQ ID NO: 214172 - DNA, 499 bp, Homo sapiens
  misc_feature: GYAE6OF01B13CM.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggcccatccaggttcaggtggcagtgctagtttgggacagattacactctcactatcagcagcctgcagcctgaagtattttgactaatttatattgtactaactattattatacgtacccctagtggtaccgttcggaccgaggggaccaagggtgaagtcaaccgactgtaggctgctacg

SEQ ID NO: 214173 - DNA, 512 bp, Homo sapiens
  misc_feature: GYAE6OF01ALRRQ.1.34.D01.1.454.CMB.1.raw
  modified_base (280)..(280): a, c, t, g, unknown or other
  misc_feature (280)..(280): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcgaagggtcgggtccccagtcccgaggttcaggtggctagtgctatcgtgggacagattacactctcactatcagcagcctgcagcctagaatntttgacttaatttatactgtacaatagttattactacgttacccctaggtggtacgttcggaccgaggggaaccaagggtagaacgtcaaaccggatggtcggctgacc

SEQ ID NO: 214174 - DNA, 393 bp, Homo sapiens
  misc_feature: GYAE6OF01A7KRY.1.34.D01.1.454.CMB.1.raw
  modified_base (377)..(377): a, c, t, g, unknown or other
  misc_feature (377)..(377): n is a, c, g, or t
  modified_base (383)..(393): a, c, t, g, unknown or other
  misc_feature (383)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaacgactgtgctgcacatctgtcttcatccttcccgcctcctcacgcactcgtctgacgcgggctgggcaagggcncatagnnnnnnnnnnn

SEQ ID NO: 214175 - DNA, 492 bp, Homo sapiens
  misc_feature: GYAE6OF01EGDAM.1.34.D01.1.454.CMB.1.raw
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatcgtgggacagtattacactctcactatcagcagcctgcagcctagaagtattttgactaattttattactgtacaactagttattactacgtaccctagtcggacgttcggccgagggaccaggtgaagtacaccgatgtgntcgcaccntctgtcttanctctcccgtacc

SEQ ID NO: 214176 - DNA, 517 bp, Homo sapiens
  misc_feature: GYAE6OF01C61TS.1.34.D01.1.454.CMB.1.raw
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgacgcccctcagatcgtagtctatggtncatccagtattgacgtaaggtcgggtccagtccgaggttcaggtggcagtgcagtcgtgggacagattacactctcactatcagcagcctgcagtcctagagtattttgacttaatttatactagtacaatattattatacgtaccctagtacggtacgttcggaccggagggtaacgaagggtacggaaagtccgaaacgtaacgtgtcggctgacc

SEQ ID NO: 214177 - DNA, 390 bp, Homo sapiens
  misc_feature: GYAE6OF01DGAI3.1.34.D01.1.454.CMB.1.raw
  modified_base (382)..(390): a, c, t, g, unknown or other
  misc_feature (382)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttttcaatttattactgtcaacagtattatagtaccctagtggacgttcggccaggggaccaaggtggaagtcaaccgactgtggctgcacatctgtcttcatccttcccgccctcctcacgcactcgtctgagcggctggcaaggcgcatagnnnnnnnnn

SEQ ID NO: 214178 - DNA, 530 bp, Homo sapiens
  misc_feature: GYAE6OF01EIE1H.1.34.D01.1.454.CMB.1.raw
  modified_base (231)..(231): a, c, t, g, unknown or other
  misc_feature (231)..(231): n is a, c, g, or t
  modified_base (324)..(324): a, c, t, g, unknown or other
  misc_feature (324)..(324): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccagggcgagcccctcagatcgtagtctatggtgcatccagattgcgaagggtcggggtcccagtccaggttcaggtggcagtncatcgtgggacagattacactctacactatcagcagcctgcacgcctagtaagtattttgacttaattttattactgtacaatattattataacgtacccctaggtcggtacggttcggaccgaggggaccaagggtaggaacgtacaaccgaactggtcgctcgcaacctatccgttcgttacttcacttcccttcccctacccc

SEQ ID NO: 214179 - DNA, 486 bp, Homo sapiens
  misc_feature: GYAE6OF01EVN5G.1.34.D01.1.454.CMB.1.raw
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgcgaagggtcgggtcccagtccgaggttcagtggcagtgcatcgtgggacagtattacactctcactatcagcagcctgcagcctagaatatttgactaatttatactgtacaatatattatacgtaccctagtggacgttcggccgagggacaggtgaagtcaacgatgngntgc

SEQ ID NO: 214180 - DNA, 401 bp, Homo sapiens
  misc_feature: GYAE6OF01DQ93S.1.34.D01.1.454.CMB.1.raw
  modified_base (394)..(401): a, c, t, g, unknown or other
  misc_feature (394)..(401): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtaattatagtacccctacgtggacgttcggccaggggaaccaaggtggaagtcaaaccgaactgtggctgcacatctgtcttcatcttcccgcatctagaacgcactcgtctagaggcgggctagggaccaagggcacaatagnnnnnnnn

SEQ ID NO: 214181 - DNA, 554 bp, Homo sapiens
  misc_feature: GYAE6OF01CCJOH.1.34.D01.1.454.CMB.1.raw
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccgaggttcagtggcagtgcatcgtgggacagacttacactctcactatcagcagcctgcagcctagaacgtatttgactaatttattactgtacaatagtattactacgtacccctaggtacggtacgttcggccgtaaggggacctaagggtacggtaacgtaccgaaaccggtaacgtcggtcgggtactacggcctaacccgtagttccgttcggttaccctttacgaaccttccgttacccccgtaccg

SEQ ID NO: 214182 - DNA, 538 bp, Homo sapiens
  misc_feature: GYAE6OF01EU6S3.1.34.D01.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccngggcgagcccctnagatcgtagtctagtggtgcatccagtattggacgaagggtcgggtcccagtccgaggttcagtggcagtgcagtcgtgggacagtatacactctcactatcagcacgcctgcagcctagaagtatttgacttaatttacttactgtactaactagttattactacgtacccttaggtcggtaacgttcgggaccgtagggggaaccctaagggtcggtaaacgtaccgtaaaccggtaactaggtcgggtctgacccg

SEQ ID NO: 214183 - DNA, 524 bp, Homo sapiens
  misc_feature: GYAE6OF01D69PZ.1.34.D01.1.454.CMB.1.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaccngggcagcccctnagatcgtagtctatggtgcatccagtattggcaagggtgggtacccatcccgaggttcaggtggcagtgcagtcgtagggaacagtattaacactctcaactatcaagcacgcctgcagctagagtntttgctaatttatactgtacaactagttatatacgtaccctaagtcggtaccgttcggccgtaggggtaccaagggtacggaagtaccgtaacgaaacgttggtacggctggaaccc

SEQ ID NO: 214184 - DNA, 584 bp, Homo sapiens
  misc_feature: GYAE6OF01CS31V.1.34.D01.1.454.CMB.1.raw
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcgaagggtcgggtcccagtccgaggttcaggtggcagtgcagtcgtgggacagtattacactctcactatcagcacgcctgcagcctagaagtnttttagacttaaatttattacgtgtacctaacgtagttaacttacgtaaccgttaccccgttaaggttcgggtaccggtttaccgggacccgtaaggggggtaacccctaaagggggttaccgggaaacgttacccgtaaaaccccggtaacggttgggtacggtccgttcgggaaccc

SEQ ID NO: 214185 - DNA, 526 bp, Homo sapiens
  misc_feature: GYAE6OF01BZLZO.1.34.D01.1.454.CMB.1.raw
  modified_base (519)..(519): a, c, t, g, unknown or other
  misc_feature (519)..(519): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtcgggtcccatcaggttcagtgcagtgcatcgtgggacagattacactctcactatcagtcagccctagcagcctagaagtattttgactaagttttacttaacgtcgtactaaactaagttatttaactacggttaacccctagtcggtacgttcggccgtaaggggaccgtaaggtaggaacgtacgaacgaactagtcggntgacccg

SEQ ID NO: 214186 - DNA, 413 bp, Homo sapiens
  misc_feature: GYAE6OF01ENL5J.1.34.D01.1.454.CMB.1.raw
  modified_base (399)..(413): a, c, t, g, unknown or other
  misc_feature (399)..(413): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattacctgtcaacagtattatacgtacccctagtggacgttcggccaggggaccaaggtggaagtcaaccgactgtgctgcaccatctgtcttcactcttcccgctatctagacgcactcgtctggacgcgggctgggaccaagggccgacatacggnnnnnnnnnnnnnnn

SEQ ID NO: 214187 - DNA, 495 bp, Homo sapiens
  misc_feature: GYAE6OF01ED0Q1.1.34.D01.1.454.CMB.1.raw
  modified_base (394)..(394): a, c, t, g, unknown or other
  misc_feature (394)..(394): n is a, c, g, or t
  modified_base (489)..(489): a, c, t, g, unknown or other
  misc_feature (489)..(489): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctcagatcgtagtctatggtgcatccagattgcaaggtgggtcccagtccaggttcagtggcagtgcatcgtgggacagattacactctcactatcagcagcctgcagcctagaagtnttttgactaattttactactgtacaatagtattatactaccctagtgtacgttcggcgaggggaccaagggaggtaagactaacgaactgtcggntggacc

SEQ ID NO: 214188 - DNA, 507 bp, Homo sapiens
  misc_feature: GYAE6OF01AMAJ4.1.34.D01.1.454.CMB.1.raw
  modified_base (279)..(279): a, c, t, g, unknown or other
  misc_feature (279)..(279): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctatggtgcatccagattgcaaggtgggtcccatccaggttcagtggcagtgcatcgtgggacagattacactctcactatcagcagcctgcagcctagaagtnttttgactaatttattactgtacaactagttattatacgtacccctagtcggtaccgttcgggccgtaggggaccaagggtcggaacgtcgaaccgacgttgtcggcgtgaccc

SEQ ID NO: 214189 - DNA, 512 bp, Homo sapiens
  misc_feature: GYAE6OF01BAYVI.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaagggtcgggtcccatccgaggttcaggtggcagtgcagtcgtgggacagattacactctcactatcagcagcctgcagcctagaagtatttgctaatttacttactgtacaactagtattactacgttaccctaggtcggacgttcggccgtaggggaccaagggtacgaagtaccaaacggtacgtggtcggctgtacc

SEQ ID NO: 214190 - DNA, 501 bp, Homo sapiens
  misc_feature: GYAE6OF01CPRGY.1.34.D01.1.454.CMB.1.raw
  modified_base (282)..(282): a, c, t, g, unknown or other
  misc_feature (282)..(282): n is a, c, g, or t
  modified_base (411)..(411): a, c, t, g, unknown or other
  misc_feature (411)..(411): n is a, c, g, or t
  modified_base (495)..(495): a, c, t, g, unknown or other
  misc_feature (495)..(495): n is a, c, g, or t
  modified_base (497)..(498): a, c, t, g, unknown or other
  misc_feature (497)..(498): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccagggcgacgcccctnagatcgtagtctagtggtgcatccagtattggacgaagggtcgggtacccagtcccgaggttcaggtggcagtgcagtcgtagggacagtacttacactctacactatcagcagcctgcagctagaatntttgattaatttatactagtacaatattattatacgtaccctagtcggtacgttcggcgagggaccaggtgagacaacgactgngnngac

SEQ ID NO: 214191 - DNA, 544 bp, Homo sapiens
  misc_feature: GYAE6OF01EIT8H.1.34.D01.1.454.CMB.1.raw
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcggtagtctatggtgcatccagtattgcaagggtcgggtcccagtcccaggttcagtggcagtgcagtctgggaacagtattacactctacactatcagcagcctgcagcctagaagtnttttgacttaatttattactgtactaaatagtaattactacgttaccccgtacgttgggtaccgttccgggaccggtaggggaaccgtaagggtacggtaacgtaccgtaaacccgtaacgtggtcggcttggaacccg

SEQ ID NO: 214192 - DNA, 554 bp, Homo sapiens
  misc_feature: GYAE6OF01CNPSH.1.34.D01.1.454.CMB.1.raw
  modified_base (103)..(103): a, c, t, g, unknown or other
  misc_feature (103)..(103): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
tcagacgagtgcgtcacgaccggtgctcgatttagatcgtctgtgttggggtttgggggagtcagaccctgtcaggacacagcatggacatgagggtccccgntcagctcctggggctcctgctgctctggctcccaggtaccagctgtgacatccaattgacccagtctccatccctccctgtctgcatctatggagacagacgtcaaccatccagttggcccgggcaagtcaaggccatccgagcgtattctttagccttggttncagcaagaaccngggcacgcccctnagatccgtagtctaatggtgcatccagtattgacgtaaggtcgggtacccatcgagttcaggtggcagtnactatcgtggacagtntaacgctntcgatactacagcacgctgacagctagaatntttgacttaagtttatactagtactaacgtattaattacgtaccgtaacccgtaggttcgggaaccgtttccgggaccgaaggggtaaccaaagggtcgaaacgttccgaaaccgtagttacgcggtcgtcggaacc

SEQ ID NO: 214193 - DNA, 541 bp, Homo sapiens
  misc_feature: GYAE6OF01CU75O.1.34.D01.1.454.CMB.1.raw
  modified_base (269)..(269): a, c, t, g, unknown or other
  misc_feature (269)..(269): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccngggcgagcccctcagatcgtagtctagtggtgcatccagattgacgaagggtcgggtacccatccaggttcagtggctagtgcatcgtgggacagtattacactctcactatcagcagcctgcagcctagaagtattttgactaatttatacttgtactaactagttaattactaaccgttaccctaggttacggtacggttaccggaccggtaggggaaccgtaagggtaggaacgttaccgaaaccggtaagtaggtcggcgttggaccc

SEQ ID NO: 214194 - DNA, 397 bp, Homo sapiens
  misc_feature: GYAE6OF01AJDKT.1.34.D01.1.454.CMB.1.raw
  modified_base (386)..(397): a, c, t, g, unknown or other
  misc_feature (386)..(397): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccagggggaccaaggtgaagtcaaccgaactgtggctgcaccatctgtcttcatcttcccgccatctgaacgcactcgtctgagcgggctggcaaggcgcatagcnnnnnnnnnnnn

SEQ ID NO: 214195 - DNA, 555 bp, Homo sapiens
  misc_feature: GYAE6OF01DSY0F.1.34.D01.1.454.CMB.1.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (433)..(433): a, c, t, g, unknown or other
  misc_feature (433)..(433): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctctggctcccaggtaccagctgtgacatccaattcgacccagtctccatccctcctgtctgcatctatggagacagatcaccatcacttggccgggcagtcaggccatcagcgtattcttagccttggttncagacaagaaaccgngggcgacgcccctnagtatcgtagtctagtggtncatccagtattcggacgtaaggggtcggtacccaagtccgtaggttcgaggtcggctaggtcgctagtcgtagggacagtacttacactcactactatcagcacgcctagcacgctagaacgttntttgacttaatttactacgtagtaaccaattagttaacttacgtaaccgtaccctaggtcgtaccgttcggacgaaggggactaagggtcgaacgtaccgaaccggtactggcgcgtcgacc

SEQ ID NO: 214196 - DNA, 519 bp, Homo sapiens
  misc_feature: GYAE6OF01ED9C5.1.34.D01.1.454.CMB.1.raw
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgaagcagaaaccagggcgagcccctnagatcgtagtctatggtgcatccagattgcgaaggtggggtcccatccaggttcagtggcagtgcatcgngggacagattacactctcactatcagcagcctgcagcctagaagtattttgactaatttattactgtactaactagttaattactacgtacccctagtcggtaccgttcggaccgtacggggaccaagggtcggaacgtacgaaccgtaactggtaggctgctaaccg

SEQ ID NO: 214197 - DNA, 497 bp, Homo sapiens
  misc_feature: GYAE6OF01EIAVW.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtcgggtcccatcccaggttcagtggcagtgcatcgtgggacagattacactctcactatcagcagcctgcagcctagaagtattttgactaatttatactgtacaactagttattatacgtacccctagtcggacgttcggcgtaggggaccaggtggaagtcgaaccgactgtggctgacc

SEQ ID NO: 214198 - DNA, 534 bp, Homo sapiens
  misc_feature: GYAE6OF01BGSYE.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgagcccctnagatcgtagtctatggtncatccagtattgacgtaaggggtcgggtccccaagtcccgtaggttcaggtggacaggtgcatcgaggggacagtattacactctacactatcagcacgctgcagcctgaagtatttgactaatttatactgtacaatagttaatagtacgtaccctaggtcggaccgttcgggacgtaggggacctaagggtcggtaaacgtaccgtaaaccgagttggtggtcgtggtaacccg

SEQ ID NO: 214199 - DNA, 503 bp, Homo sapiens
  misc_feature: GYAE6OF01EUKZW.1.34.D01.1.454.CMB.1.raw
  modified_base (282)..(282): a, c, t, g, unknown or other
  misc_feature (282)..(282): n is a, c, g, or t
  modified_base (496)..(496): a, c, t, g, unknown or other
  misc_feature (496)..(496): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagtattgacgaagggtcgggtcccatcccgaggttcaggtggcagtgcatcgtgggacagtattaccactctacactatcagcagcctgcagcctagaagtattttgacttaatttactactgtacaactagttattatacgtaccctagtggacgttcggcgtagggacagggtgaacgtacaacgatgngctgacc

SEQ ID NO: 214200 - DNA, 585 bp, Homo sapiens
  misc_feature: GYAE6OF01EV9S0.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgacgcccctcagatcgtagtctagtggtgcatcagtattgcaagggtcgggtcccagtccgaggttcagtggcagtgcatcgtagggacagtattacactctacactatcagcagcctagccagtacctagtaagttacttttcgacttaattttacttactagttacctaaacttaagttaatttacgtaaccgttaccccgttaggttaccgggtaccgtttacgggacccgtaagggggaacccgtaaaggggtacggtaaaccggttaccgaaaacccggtaacgttacgggttacggccgttacggaccc

SEQ ID NO: 214201 - DNA, 585 bp, Homo sapiens
  misc_feature: GYAE6OF01CR9QP.1.34.D01.1.454.CMB.1.raw
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccggngagtcaggccatcagcgtattctttagctggtncagacagaaaccnggcagcccctcagatcgtagtctagtggtgctatccagagttgactaaggtcgggtcccagtccaggttcaggttggctagtgcatctgggacagacttacacttctacacttatcagcacgtctgcacgtcctagtaagtactttagacttaatttacttacctagtcctaaacgtacgttaatttacgtaaccggttaccccgtaaggtacgggtaccggtttaccgggaccggtaagggggtaaacccaaggggtttaaccggaaacggttacccgtaaacccgggtaacttagggtcggtaccgttggtaacccc

SEQ ID NO: 214202 - DNA, 559 bp, Homo sapiens
  misc_feature: GYAE6OF01CG205.1.34.D01.1.454.CMB.1.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgngggccgacgcccctnagatcgtagtctatggtgcatccagattgcgaagggtcgggtacccagtccgaggttcagtggcagtgcatcgtgggacagacttacactctctaactatcaagcacgcctagcacgcctagtaaagtattttgaacttaattttacttacgtagttaccaaactagttaattactaccgttaaccccgtaggtcggtaaccgtttccgggaccgtagggggaacctaaggggtacggaaacgtaccgaaaccggtaatggacggtcgtacgaccg

SEQ ID NO: 214203 - DNA, 563 bp, Homo sapiens
  misc_feature: GYAE6OF01DFV2X.1.34.D01.1.454.CMB.1.raw
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (407)..(407): a, c, t, g, unknown or other
  misc_feature (407)..(407): n is a, c, g, or t
  modified_base (556)..(556): a, c, t, g, unknown or other
  misc_feature (556)..(556): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttggccgggngagtcaggccatcagcgtattcttagcctggtgcagcaaggaaaccgngggcgaacgcccctcagatcgtagtctagtggtgacatccagtattggacgtaaggggtcggggtaccccaagtcccgtaggttcaggtggcaggtcgctatcggtagggacagtacttacacttctactacttancaagcagcctgcagcctagaattatttgacttaatttactacgtagtacaaactagttattaactaccgttaaccccttaggtacggtacggtccggaccggaaggggacgtaagggtacggaaacggtacaaaccggagtggtacggntcggacc

SEQ ID NO: 214204 - DNA, 421 bp, Homo sapiens
  misc_feature: GYAE6OF01EKW0Z.1.34.D01.1.454.CMB.1.raw
  modified_base (356)..(356): a, c, t, g, unknown or other
  misc_feature (356)..(356): n is a, c, g, or t
  modified_base (397)..(399): a, c, t, g, unknown or other
  misc_feature (397)..(399): n is a, c, g, or t
  modified_base (401)..(401): a, c, t, g, unknown or other
  misc_feature (401)..(401): n is a, c, g, or t
  modified_base (403)..(413): a, c, t, g, unknown or other
  misc_feature (403)..(413): n is a, c, g, or t
  modified_base (418)..(421): a, c, t, g, unknown or other
  misc_feature (418)..(421): n is a, c, g, or t
tcagacgagtgcgtcacgaccggtgctcgatttagatcgtctgtgttggggtttggggagtcaggccatcagcgattctttagcctggttgcagcagaaaccagggcgagcccctcagatcgtagtctatggtgcatccagattgcaaggtgggtcccatccaggttcagtggcagtgcatctgggacagacttacactctcactatcagcagcctgcagcctagaagtattttgacttaatttattactgtacaacagtattatacgtaccctagtggacgttcggccagggggaccaagggtggaagtcaaccgaactggtggctgacacatctgtcttcatctcccgcactcngacgcactcgtctggacgcggtctggccaagggcacagtgnnncncnnnnnnnnnnnggggnnnn

SEQ ID NO: 214205 - DNA, 567 bp, Homo sapiens
  misc_feature: GYAE6OF01C1JAD.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagatcaccatcacttggccgggcagtcaggccatcagcgtattctttagcctggttgcagcaagaaaccgagggcgacgcccctcagatcgtagtctatggtgcatccagattgacgaaggtcgggtcccatccgaggttcaggtggcagtgctagtcgtgggacagtacttacactctcaactatcagcagcctgcagcctagaatatttgacttaaattttacttaactgtactaactagttaacttactacgttaaccccttaggtacggtacggttaccgggaccggtaaggggaacccgtaaaggggttcggaaaacggtaccgtaaaacccgggtaacttgggtacggtccgtgggtaaccc

SEQ ID NO: 214206 - DNA, 497 bp, Homo sapiens
  misc_feature: GYAE6OF01BU53X.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacaacatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaagggtcggggtcccatccaggttcagtggcagtgcatctgggacagattacactctcactatcagcagcctgcagcctagaagtattttgacttaattttattactagtacaactagttattatacgtaccctagtggtacgttcggaccgagggaccagggtgaagtcaacgtactgagctgcac

SEQ ID NO: 214207 - DNA, 505 bp, Homo sapiens
  misc_feature: GYAE6OF01B5BKA.1.34.D01.1.454.CMB.1.raw
  modified_base (280)..(280): a, c, t, g, unknown or other
  misc_feature (280)..(280): n is a, c, g, or t
  modified_base (379)..(379): a, c, t, g, unknown or other
  misc_feature (379)..(379): n is a, c, g, or t
  modified_base (420)..(420): a, c, t, g, unknown or other
  misc_feature (420)..(420): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagatttgcgaagggtcgggtcccagtccgaggttcaggtcggcagtgcatctgggacagtattacactctcactancagcagcctgcagcctagaatatttgactaatttatacgtntacaatagttattatacgtaccctagtacggacgttcggccgaggggacctaaggtcggaagtcgaaacgactggtcggctgacc

SEQ ID NO: 214208 - DNA, 572 bp, Homo sapiens
  misc_feature: GYAE6OF01D33W8.1.34.D01.1.454.CMB.1.raw
  modified_base (143)..(143): a, c, t, g, unknown or other
  misc_feature (143)..(143): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (419)..(419): a, c, t, g, unknown or other
  misc_feature (419)..(419): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattgacccagtctccatcctccctgtctgcatctattggagacagagtcaccatcacttgccgggcgagtcaggccatcagcgattcttagcctggttgcagcaagaaaccngggcgacgcccctnagatcgtagtctatggtgcatccagtattgacgaagggtcgggtcccatccgtaggttcaggtggcaggtgctagtcgtggggaacaggtaacttacactctcaacttatcagcacgcctgcagtcctaggtaactnttttgacttaaattttactacgttgtacaacgttagttaacttacgtaacgtaccccgttaggtaccggtaccgttccgggaccgtaagggggtacctaaaggggtacggtaaacgtaccgaaaccggttaacggtggtcggctggtaacccg

SEQ ID NO: 214209 - DNA, 590 bp, Homo sapiens
  misc_feature: GYAE6OF01CNZAS.1.34.D01.1.454.CMB.1.raw
  modified_base (102)..(102): a, c, t, g, unknown or other
  misc_feature (102)..(102): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttggggtttgggggagtcagaccctgtcaggacacagcatggacatgagggtccccntcagcctccgtggggctcctgctgctctggctcccaggtaccagctgtgacatccaattcgacccagtctccatcctccctgtctgcatctatggagacagagtcacatcacttggccgggcgagtcaggccatcagcgtattcttagctggtncagcaagaaccgngggcacgcccctanagactcgtagtctagtggtncatccagtattcgacgtaaggggtcggtaccagtccgtaggttcaggtcggctaggtgctaagtcgagggactaggtacttacgactctacactatcagcacgtcctgacacgtctaggtaacgttattttagactttaattttacttacgtagtaacctaaagtaagttaattacgtaaccgtttacccgtaggtacggttaccggttacgggacggtaacggggaaccgtaaggggtacgaaacgttaccgaaacccggtagttagggtacgtcgtcggtaaccc

SEQ ID NO: 214210 - DNA, 535 bp, Homo sapiens
  misc_feature: GYAE6OF01D1C5T.1.34.D01.1.454.CMB.1.raw
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcancctgcagcctgtaanattttgactaatttacttactagtactaactagttaattattaacgtaccccgttacgtcgggtacgtttccgggacctaagggggaaccctaagggtacggtaaagtacgtaaacccggaacttggtacggctcggtaccg

SEQ ID NO: 214211 - DNA, 535 bp, Homo sapiens
  misc_feature: GYAE6OF01EGVGC.1.34.D01.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcaagaaaccngggcacgcccctnagatcgtagtctatggtncatccagtattgacgtaagggtcgggtcccagtccgaggttcaggtggcaggtcgcatcgtagggacagtattacactctcactatcagcacgcctgcagcctagaatattttgactaattttatactgtactaactagttaattactaccgttaaccctaggttacggacgtttccgggaccgtaggggacctaagggtacggaacgtacaaaccggtactggtcggctggacc

SEQ ID NO: 214212 - DNA, 524 bp, Homo sapiens
  misc_feature: GYAE6OF01AI968.1.34.D01.1.454.CMB.1.raw
  modified_base (281)..(281): a, c, t, g, unknown or other
  misc_feature (281)..(281): n is a, c, g, or t
  modified_base (407)..(407): a, c, t, g, unknown or other
  misc_feature (407)..(407): n is a, c, g, or t
  modified_base (515)..(515): a, c, t, g, unknown or other
  misc_feature (515)..(515): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctnagatcgtagtctatggtgcatccagtattgcgagggtcgggtcccagtccaggttcaggtgcagtgctatcgagggacagtacttacacttctcactatcacgcacgccgtgccagccgtagaatnttttagacttaattttacttactgtacaatagttattactacgtaccctagtcggtacgtcgcgtacgggactagggtacgaacgtaccgaaaccgtacgtaggcggngtcgtaccg

SEQ ID NO: 214213 - DNA, 495 bp, Homo sapiens
  misc_feature: GYAE6OF01AYRG1.1.34.D01.1.454.CMB.1.raw
  modified_base (257)..(257): a, c, t, g, unknown or other
  misc_feature (257)..(257): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgcaaggtcgggtcccatccaggttcaggtggcagtgcatcgtgggacagattacactctcactatcagcagcctgcagcctagaagtattttgactaatttatactgtacaactagtattactacgtacccctaggtcggtacgttcgacgagggaccaggtgaactcgaaccgatggtgctgccacntctgtctcnctccgtcccgccc

SEQ ID NO: 214214 - DNA, 510 bp, Homo sapiens
  misc_feature: GYAE6OF01AS1UX.1.34.D01.1.454.CMB.1.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccngggcacgcccctnagatcgtagtctatggtgcatcagattgacaaggtcgggtcccatcccaggttcaggtggcagtgcatcgtgggacagattacactctcactatcagcagcctgcagcctgaatntttgacttaatttactactgtacaatagtattactacgttaccctagtcggtacgttcggaccgtaggggacctaagggtcggaaagtccgaaaccggtactggtcgcgttggaccc

SEQ ID NO: 214215 - DNA, 576 bp, Homo sapiens
  misc_feature: GYAE6OF01D7MUB.1.34.D01.1.454.CMB.1.raw
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaccatcacgttgccgggcgagtcaggccatcagcgtattcttagcctggttgcagcagaaaccgagggcgacgcccctnagtatcgtagtctagtggtcncatccagtattgacgaagggtcgggtacccagtccgtaggttcaggtggactaggtgcagtcgtagggactagtacttacactctactactancagccagtccctagccacgaccgttagaacgtttattttcgaacttaattttacgtacttacgtaactaaacgtagtttaacttacgttaccgttacccgtaggttcggaaccggttcgggaccggtaggggaacctaaggggacgtaaacgtccaaacgtagtggcgtcgtcgacc

SEQ ID NO: 214216 - DNA, 848 bp, Homo sapiens
  misc_feature: GYAE6OF01B1SPN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccgagtacagctgtcgactactacctaagttccgacctacgtcctacctacttcccctcccgtgtctcgactattacttagtaggacgacgagtacgtaccaacctactacctacgttcgggccgggacgtacgtacgacggacctatacgacggtacgttacttttccgtttacgtccgtttggttcgacgacgacgaaaacggaaccggcgggaccgacccgtccccgtagaacgtacgttacggtacgttcgtaggtggtacactacgtacgagttagttacggacggtaacggggtccggtacctacgtaccggtaggttacgacggtcgacgtagtcgacgtacgttcgggaacgacgtaagttaccttaacctaccgttacctaaccgtaaacttacgtaccgaaccggtacccgtacccggtcccgtacggaacccgtaccggttaaccgttaaaggtttaaacgtttttacgtttaaccgtaactttttaaagtttttaccgttaaccgttaaccgtaaaccttaaagtttaaacgtttaccgtttaaccgttaaccccccggtttaacccggttaggggttacccgggttacccggggttaaccgggaaaccggggtaaccggggttaaacggttaaacggggtacggttaaacccgtaacccggttaaaccggtacggttaggggtcccgtacgtacccgtaaccg

SEQ ID NO: 214217 - DNA, 543 bp, Homo sapiens
  misc_feature: GYAE6OF01ESE30.1.34.D01.1.454.CMB.1.raw
  modified_base (133)..(133): a, c, t, g, unknown or other
  misc_feature (133)..(133): n is a, c, g, or t
  modified_base (168)..(168): a, c, t, g, unknown or other
  misc_feature (168)..(168): n is a, c, g, or t
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (405)..(405): a, c, t, g, unknown or other
  misc_feature (405)..(405): n is a, c, g, or t
  modified_base (511)..(543): a, c, t, g, unknown or other
  misc_feature (511)..(543): n is a, c, g, or t
tcagacgagtgcgtcacgaccggtgctcgattttagatcgtctgtgttgggtttgggagtcaggccatcagcgatttctttagcctggttgcagcagaaaccagggcgagccctcagatcgtagtctatggtncatccagattgcaaggtggggtcccactcgtagtnagtgntagncatgaggacagtactacncttcacaattnacgancgctcctgacaccgtactaaggaatttagttttcaactttaatttttacttacgtcgttaaccaaaagtaggtttaattaaacgtaacccgttaacccccttaagggtacggtaaccggtttccggaccgggaaacgggggaaaccggtaaggggtaaggtaaacgacccgtaaaacccgtaaggttggtcggntacggacctaactagtcttagttccttacactttcccctccgactaatctaacggaaacctctaactcgtcgtagacggcgacgtggaacgaaggcctataagtcnnnnnnnnnnnnnnnnnnnnnnnnnnnnnnnnn

SEQ ID NO: 214218 - DNA, 391 bp, Homo sapiens
  misc_feature: GYAE6OF01BE0P5.1.34.D01.1.454.CMB.1.raw
  modified_base (353)..(353): a, c, t, g, unknown or other
  misc_feature (353)..(353): n is a, c, g, or t
  modified_base (386)..(391): a, c, t, g, unknown or other
  misc_feature (386)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattatagtacccctagtggacgttcggccagggggaccaaggtggaagtcaaccgaactgtggctgcaccatctgtcttcatcttcccgcatctgaacncactcgtctgagcgggctggcaaggcgcatagnnnnnn

SEQ ID NO: 214219 - DNA, 581 bp, Homo sapiens
  misc_feature: GYAE6OF01BXDSM.1.34.D01.1.454.CMB.1.raw
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (427)..(427): a, c, t, g, unknown or other
  misc_feature (427)..(427): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatccctccctgtctgcatctatggagacagagtcaccatcacttggccgggcgagtcaggccatcagcgtatttcttagccgttggttgcagcaagaaaccgagggcgacgcccctnagatcgtagtctatggncatccagtattggcgtaagggtcgggtacccagtccgaggttcaggtcggcaggtcgactagtcggtagggacagtacttaccacttctacactatcagcagcctgcagcctagtaagttnttttagacttaattttactactgtactaatagttaacttacgtaaccgttaccctagggtcgggtaaccggttcgggaccggtaaggggaacccgtaaggggtacggtaaacgtaccgtaaaccggtaacgttgggtacggccgtaggaacccg

SEQ ID NO: 214220 - DNA, 487 bp, Homo sapiens
  misc_feature: GYAE6OF01A7M00.1.34.D01.1.454.CMB.1.raw
  modified_base (481)..(481): a, c, t, g, unknown or other
  misc_feature (481)..(481): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttattatacgtaccctagtggacgttcggccaggggacaagggtgaagtcaacggactgngctgac

SEQ ID NO: 214221 - DNA, 508 bp, Homo sapiens
  misc_feature: GYAE6OF01DIA4A.1.34.D01.1.454.CMB.1.raw
  modified_base (282)..(282): a, c, t, g, unknown or other
  misc_feature (282)..(282): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagccccctnagatcgtagtctatggtgcatccagattgcaaggtcgggtcccatcccgaggttcagtggcagtgcatcgtgggacagattacactctcactatcagcagcctgcagcctagaagtattttgactaaattttntactgtacaactagttattatacgttacccctagtcggtacgtcggacgaggggacaaggtaggaagtacgaaccgaactggtacgcgtgacc

SEQ ID NO: 214222 - DNA, 563 bp, Homo sapiens
  misc_feature: GYAE6OF01DHNIW.1.34.D01.1.454.CMB.1.raw
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttggccggngagtcaggccatcagcgattcttagcctggttgcagcagaaccngggcgacgcccctnagatcgtagtctagtggtgcatccagtattggacgaagggtcggggtaccccaagtcccgaggttcaggtcggctagtgcagtcgtgggacagtacttacactctcactatcagcagcctgcagcctagaacttatttcgacttaattttaatacgtagtactaaacgtagtttaacttataccgttaacccgttaggtacggtacggttccggaccggtaaggggacctaaggggtacggaaacgttaccgaaaccggtacgtaggtcggtctcggtaacccg

SEQ ID NO: 214223 - DNA, 637 bp, Homo sapiens
  misc_feature: GYAE6OF01CBIHS.1.34.D01.1.454.CMB.1.raw
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (357)..(357): a, c, t, g, unknown or other
  misc_feature (357)..(357): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcattctattggagacagagtcaccatcacttggccgggngagtcaggccatcagcgattcttagcctggttgcagcagaaccgngggcacgcccctanagatcgtagtctagtggtcgcatccagtattggacgtaagggtcgggtcccagtcccgaggttcaggttcggntaagtcgactagtcggtagggactaggtacttaacacgttcctacgtaactacttccgagcctacgcctaggactacgtacccttaggtaaacttgttttacgaactttaaagttttacttaccgtattaacccgaaagttatttaacttacgttaacccgttaccccgttagggtaccggtccgtttaccgggaacccggtaggggtaacccgtaaggggttaccggtaaaccggttaccgaaacccggttacgttaggtacgtacggttcgtaacccg

SEQ ID NO: 214224 - DNA, 618 bp, Homo sapiens
  misc_feature: GYAE6OF01A6AMA.1.34.D01.1.454.CMB.1.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattcggagacagagtcaccatcacttgccgggcgagtcaggccatcagcgattcttagcctggttgcagcagaaaccngggccgacgcccctnagatcgtagtctagtggtcgcatccagattgcgtaagggtcgggtcccagtccgaggttcaggttcggcagtcgctagtcgtagggacagtacttacgacttctactacttatacagtctagtcctagccagtcctaggtaacgttattttcgacttaaattttacttacgttacggtaaccaaacgttaagttaacgttacgttaaccggttaccccgttaagggttacgggtaaccggtttcggggacccgtaagggggaacccgtaaaggggttacggaaacgttacccggaaaaccggttacgttagggtacggtcccgttcgggtaacccc

SEQ ID NO: 214225 - DNA, 553 bp, Homo sapiens
  misc_feature: GYAE6OF01DA22T.1.34.D01.1.454.CMB.1.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (548)..(548): a, c, t, g, unknown or other
  misc_feature (548)..(548): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgatttcttagccttggttgcagcaagaaaccgngggccgacgcccctnagactcgtagtctagtggtgctatccgagagttggacgaagggtccgggtacccagtccgaggttcgaggtcggcaggtgctagtcgtagggacagtacttacactctatactatcgacgcacgctagcacgtctagtaacgttagttttacgaactttaattttactacgttagtactaacgtagtttacttacgtaccgttacccgtggtacggtacgtcggacggtaagggacgtaggtacgaacacgaacgagtggcgntgacc

SEQ ID NO: 214226 - DNA, 487 bp, Homo sapiens
  misc_feature: GYAE6OF01A5B9A.1.34.D01.1.454.CMB.1.raw
  modified_base (396)..(396): a, c, t, g, unknown or other
  misc_feature (396)..(396): n is a, c, g, or t
  modified_base (481)..(481): a, c, t, g, unknown or other
  misc_feature (481)..(481): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcagccccctcagatcgtagtctatggtgcatccagattgcaaggtgggtcccatccaggttcaggtggcagtgcatcgtgggacagattacactctcactatcagcagcctgcagcctgaagtnttttgactaatttattactgtacaatattaattatacgtaccctagtcgacgttcggcgaggggacaggtagaagcaacgatggngctgac

SEQ ID NO: 214227 - DNA, 564 bp, Homo sapiens
  misc_feature: GYAE6OF01C65SK.1.34.D01.1.454.CMB.1.raw
  modified_base (270)..(270): a, c, t, g, unknown or other
  misc_feature (270)..(270): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccngggcgacgcccctcagatcgtagtctagtggtgcatccagtattgacgtaagggtcgggtcccagtccgaggttcaggtggcagtgacagtcgtgggacagtattacacttctacactatcagcacgcctgcagcctagaagttntttcgacttaaatttattactagtacaactagttaacttactaccgttaaccccttaggtacggtaccggttaccggaccggaacggggtaacccgtaagggtacgggtaaacgtaccgaaaccggtaactggtacgggctcggtaacc

SEQ ID NO: 214228 - DNA, 404 bp, Homo sapiens
  misc_feature: GYAE6OF01DIJ6N.1.34.D01.1.454.CMB.1.raw
  modified_base (392)..(392): a, c, t, g, unknown or other
  misc_feature (392)..(392): n is a, c, g, or t
  modified_base (397)..(404): a, c, t, g, unknown or other
  misc_feature (397)..(404): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctagaagtattttgactaaattttattactgtcaaactagtatttaatacgtacccctagtggacgttcggccagggggaccaagggtggaagtcaaccgactgtggctgcacatctgtctcatcttcccgctatctgaaccgctactcgtctgagcgggctggacaaggcnatagnnnnnnnn

SEQ ID NO: 214229 - DNA, 634 bp, Homo sapiens
  misc_feature: GYAE6OF01DGQ4M.1.34.D01.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattctttagcctggttgcagcaagaaaccgagggcgacgcccctnagactcgtagtctagtggtgacatccagattgacgtaaggtcgggtccccagtccgaggttcaggtggcagtcgacagtcgtaggggacagtaacttaacaccttcctactaacgtatccgaagccacgccctggaccacgtcctaagtaaagttactttttagacttaaatttttaacttaaccttagttaacctaaacgttaagttaactttaacgtaaccgttacccccgttaacgggtaccgggttaaccggtttccgggacccggtaacgggggaaccctaaaggggtacgggtaaacgtaacccgtaaacccgggttaacttagggtacggtcgtcgtaaccccg

SEQ ID NO: 214230 - DNA, 554 bp, Homo sapiens
  misc_feature: GYAE6OF01ER8A9.1.34.D01.1.454.CMB.1.raw
  modified_base (226)..(226): a, c, t, g, unknown or other
  misc_feature (226)..(226): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtntttgctaattatactgtacaacagtattatacgtaccctagtggacgttcggaccaggggacctaaggtcggaacgtcgaaccgtaactggtcggctgaccaccgtatcgtcgtcttacagttcctcccgctagtcgtagaccgtctacgtcgtctaggacgtcgggcttgggactaacgggccacgtaagttagctcgactacgtcgtactacgtctagtccgtagtcgtcgtacgtcgactcgtacgtagtaccgtgtacgtcgtcgtagtccgtacgagttcgacgtgacgttgctaggtacctagccgtataccgcgtcgtacg

SEQ ID NO: 214231 - DNA, 543 bp, Homo sapiens
  misc_feature: GYAE6OF01A5SFM.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgacaagggtcgggtcccagtcccgaggttcaggtggcagtgcatcgtgggacagtattacactctacactatcagcagcctgcagcctgaagtattttgactaatttatactgtacaactagttattatacgtacccctacggttacggtaccggttcgggaccgtaagggggacccgtaaaggggtacgggtaaagtaccgaaaccgtaacgtagggtacggccgtgtacccg

SEQ ID NO: 214232 - DNA, 498 bp, Homo sapiens
  misc_feature: GYAE6OF01EY29T.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagatacactctcactatcagcagcctgcagcctgaagtattttgactaatttattactgtacaaactagttaattatagtacccctagtggaacgttcggcctaggggaccaaggtggaagtacaaccggaactgtggctgaccg

SEQ ID NO: 214233 - DNA, 538 bp, Homo sapiens
  misc_feature: GYAE6OF01B60RS.1.34.D01.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctnagatcgtagtctatggtncatccagtattggacaagggtcgggtccccagtcccgaaggttcaggtcggcaggtgcagtctagggacagattacactctacactatcagcagcctgcagcctagaatntttgactaattttacttactgtacaactagttattactacgttaccctagtacggtaccgttccgggaccgtaggggaccctaagggtacggaaagtacctaaaccggtacgtaggtcggtcgtgaccc

SEQ ID NO: 214234 - DNA, 697 bp, Homo sapiens
  misc_feature: GYAE6OF01DO2LQ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaatttacccagtctccatcctcctgtctgcatctattggagacagagtcaccatcacttgccgggcgagtcaggccatcgagcgattctttagcctggttgcagcagaaaccagggcgagcccctcagatcgtagtctatggtgcatccagtattgcaaggtggggtcccatccgaggttcagtggcaggtgctatcgtaggggactaaggtactttaacgactctaccgaacttaatccaaggcctaacggcccttggacctaacggcccgttaggaaacgtttacgttttttacggacctttaaagttttttaactttaaccgttaggtttaaccctaaacgtaacggttttaaattttaaccgttaaccgggtttaaaccccccgttaaccgggttacggggtaacccgggttttacccggggaaccccggtaaacggggggggtaaccccgtaaaagggggttcgggtaaaaccggttacccggaaaaccccgggttaacgttacgggtacgggtaccttacgggcccgttaaaccccg

SEQ ID NO: 214235 - DNA, 707 bp, Homo sapiens
  misc_feature: GYAE6OF01DF46W.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccactactcgtcggcgagtcacggacgactacagacgtacttctttacgtcgtcggttgtcacgacgacgaaaccgaacggacggaccgacccgtcctagaacgtcggttacggttacgtacgttcggtggtcacttacccgaacgagtttacggacgtaacgggttaaccgggggtcccgtaccgtaccgtacgggttacggtacggtagggtacgtacggttacggctaagttcggtacggggtaaccgaagtaacgtttaacctaacccgttccttactacttaaactcgaagaccgtacgcccttcgacgacgtaccgttacgtaaaggttactttttagacttaattttaagttttacctacggtactaactaagtttaagttacttacgtaaccccgttacgtagggtaccggttaccggtaccggaacgggaacggtacggttaagggaaccgtacgaaacccgtaacggttcggtaggctacgctaaacccg

SEQ ID NO: 214236 - DNA, 520 bp, Homo sapiens
  misc_feature: GYAE6OF01A8NMJ.1.34.D01.1.454.CMB.1.raw
  modified_base (255)..(255): a, c, t, g, unknown or other
  misc_feature (255)..(255): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcaagaaaccagggcgacgcccctnagatcgtagtctagtggtgcatccagattggacgaagggtcgggtcccagtccgaggttcagtggacagtcgcagtcgtagggacagattacactctacactatacagcagcctgcacgcgtagtaagtatttgactaatttactactgtacatagttattactacgtaccctagtcggtacgttcggacgtaggggacctagggtacggaacgtacgtaaccgagtgtcgctgaccg

SEQ ID NO: 214237 - DNA, 517 bp, Homo sapiens
  misc_feature: GYAE6OF01D83B2.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgngggcacgcccctnagatcgtagtctatggtgcatccagattgacgaagggtcgggtcccatccaggttcaggtggcagtgcatcgtgggacagattacactctcactatcagcacgcccgnacgcctagtaagtnttttagacttaatttacttactgtactaatagttattactacgtaccctaggtcggtacgtcggaccgaggggtaccaagggtcgaacgtacgaaccgtagtgtggctgctaac

SEQ ID NO: 214238 - DNA, 552 bp, Homo sapiens
  misc_feature: GYAE6OF01A2O7R.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtggcagtgcatctgggacagattacactctcactatcagcagcctgcagcctgaagtattttgacttaatttacttactgtacctaaactagttatttaacgtaacggtacccccttaggttcggtaaccggtttccgggacccgtaaggggggacccgtaaaggggttacggaaacgttacgaaacccggtaacgttaggtcgggccttggaacccg

SEQ ID NO: 214239 - DNA, 749 bp, Homo sapiens
  misc_feature: GYAE6OF01DD1AY.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtggttgggtttgggggagtcagaccctgtcaggacacagcatggacactgaggtcccgntcagctcctgggctcctgctgctctggctcccgaggtaccagctgtgacatccaattcgaccagtctccatcctcctgtctgcgatctatcggacactagagtcaccgatcacgttggccgggtctagtccaggtccctagtccaggaccgtaattacctttaggcccttgggttcgaccgaggcctaacggaaaccgaggggtccgtaacggcccccgttacagtaacgttccggtaaggtcgtaacgtggtcgacctaactacccgaagtacgttggacgaaacgggttcgggtaccccagttacccgtaggtttaccagggttacggctaacggttcgactagttaccgtagggaacctaggtaacttaccgtacttccgttacctaaccttagtaccgtacgtcgaccgttacctacggtaccgtagtcccgtaagtaaacgttattttcggaacttaaacgtttttacgttaaccgttacgtaccgttaacgttaacggtttaactttaacgttaacccgttaccccgttaggttaccgggtaccggtttacccggggaaccgtaacggggggtaacctaaacggggtacggtaaccgtaacccgtaaaccggtaactgggttacggtcgtaacggtaaccc

SEQ ID NO: 214240 - DNA, 397 bp, Homo sapiens
  misc_feature: GYAE6OF01A1MZ8.1.34.D01.1.454.CMB.1.raw
  modified_base (384)..(384): a, c, t, g, unknown or other
  misc_feature (384)..(384): n is a, c, g, or t
  modified_base (391)..(397): a, c, t, g, unknown or other
  misc_feature (391)..(397): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagccagcctgcagcctgaagattttgctaatttattactgtcaacagtattatacgtacccctagtgacgttcggccaggggtaccaaggtggaatcaaccgaactgtggctgcacatctgtcttcagtccttcccgccagtctgaacgcactcgtctgagcgggctggcaagggccnctatagnnnnnnn

SEQ ID NO: 214241 - DNA, 531 bp, Homo sapiens
  misc_feature: GYAE6OF01ASFSU.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgctaagggtggggtcccatccgaggttcaggtggcagtgcatcgtgggacagattacactctcactatcagcagcctgcagcctgaatatttgactaatttatactgtacaactagttattactacgttacccctaggtacggtaccgttacgggcccgtaaggggaccgtaagggtacgggaaacgttaccgaaacccggtacgtacggtggccgtgaccg

SEQ ID NO: 214242 - DNA, 404 bp, Homo sapiens
  misc_feature: GYAE6OF01DHAFU.1.34.D01.1.454.CMB.1.raw
  modified_base (243)..(243): a, c, t, g, unknown or other
  misc_feature (243)..(243): n is a, c, g, or t
  modified_base (386)..(386): a, c, t, g, unknown or other
  misc_feature (386)..(386): n is a, c, g, or t
  modified_base (393)..(404): a, c, t, g, unknown or other
  misc_feature (393)..(404): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctgaagtattttgactaattttntactgtcaacagtattatacgtacccctagtcggaacgttcggccaggggaccaaggtggaagtcaaccgatggtgctgcaccatctgtcttcatcttcccgcatctgaacgctactcgtcgtgagcgggctaggcaacggcncaatagnnnnnnnnnnnn

SEQ ID NO: 214243 - DNA, 596 bp, Homo sapiens
  misc_feature: GYAE6OF01CUSZ2.1.34.D01.1.454.CMB.1.raw
  modified_base (270)..(270): a, c, t, g, unknown or other
  misc_feature (270)..(270): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatccagcgtattctttagcctggttgcagcagaaaccngggcacgcccctcagatcgtagtctagtggtgcatccagtattggacgaagggtcgggtcccagtcccgaggttcaggtggcagtcgcagtcgtggggacagtattaccacttctacactatcagcacgcctgacgacgcctagtaagtattttagacttaattttattacgtagtactaactagttaattacgtaaccgttaccccgttacgggtcggtaccggtttccgggacccggtaagggggtaacccgtaaaggggttacggaaaacggttacccgtaaaacccgggtaacgttagggtacgggtccgttacggaacccg

SEQ ID NO: 214244 - DNA, 572 bp, Homo sapiens
  misc_feature: GYAE6OF01CFVEJ.1.34.D01.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (382)..(382): a, c, t, g, unknown or other
  misc_feature (382)..(382): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgtattcttagcctggttgcagcagaaaccagggcgagcccctnagatcgtagtctagtggtgcatccagattgacgaaggtcgggtccatccgaggttcaggtggcagtgcatcgtgggacagattacactctcactatcagcncgaacctgacagcctagtaagtatttacgacttaatttacttacgtacgtactaaacgtagttacttaacgtaaccgttaaccccgttacggtacggtaccggttaccgggtacccggtaacgggggtaaccgtaacgggtacgggtaaacgttaccgaaaccggtacgttaggtcggtctcggtacccg

SEQ ID NO: 214245 - DNA, 531 bp, Homo sapiens
  misc_feature: GYAE6OF01EHL9P.1.34.D01.1.454.CMB.1.raw
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcgaaggtgggtcccatccaggttcagtggcagtgcatcgtgggacagattacactctacactatcagcagcctgcagcctgaatatttgactaatttatactgtacaactgttaattatacgtaccctaggtcggtacgttcggaccgaggggaccaagggtcggaacgtacaaaccgaacgtggtacggntacggaccaaccgtnttaccgttgttacttacctacttcccttccccgtacccc

SEQ ID NO: 214246 - DNA, 635 bp, Homo sapiens
  misc_feature: GYAE6OF01C1O64.1.34.D01.1.454.CMB.1.raw
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatcctccctgtctgcatctattggagacagagtcacatcacttggccgggcgagtcaggccatcagcgtatttctttacgccgttggttcgcagacaacgaaaaccgagggaccgacgaccccctcagactcgtagtctagtggtgactatccagacgttgacggaaacggttcggggtacccctacgtaccgtaaggtttccgaaggttcgggaccgtaaggtcgactaacgttcggtacgggacctaggtaacttaacaccttactactacctaatcaacgctacgcctgtcacgtcgtagtaattntttacgtaactaattttaactacgttatacgtaactagttatacgtaaccgtacccgtacggtacggtaccggttaccggaccggtaacggggaacgtaagggtacggtaacccgtacgtaaaccggtacgttcggtacgcgttcgtaacccg

SEQ ID NO: 214247 - DNA, 547 bp, Homo sapiens
  misc_feature: GYAE6OF01EJWB5.1.34.D01.1.454.CMB.1.raw
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcaagaaaccgngggccgacgcccctnagatcgtagtctagtggtgcatccagtattgacgaagggtcgggtcccagtccgaggttcaggtggcagtgctagtcgtagggacagtacttaccactctacactancagcacgcctgcacgctagtaagttntttagacttaatttatactagtactaatagttattactaccgtacccgtaggtcggtaccggttccgggaccggtaggggaaccgtagggtacggaacgtaccgaaccgtacgtggtcgcgtgaccc

SEQ ID NO: 214248 - DNA, 574 bp, Homo sapiens
  misc_feature: GYAE6OF01CQSC7.1.34.D01.1.454.CMB.1.raw
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (433)..(433): a, c, t, g, unknown or other
  misc_feature (433)..(433): n is a, c, g, or t
  modified_base (564)..(564): a, c, t, g, unknown or other
  misc_feature (564)..(564): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggnagtcaggccatcagcgtattcttagcctggtgcagcagaaaccngggcgacgccccctnagactcgtatctagtggtgcatccagtattggacgtaaggggtcgggtaccccagttcccgaaggtttccaaggttcggctaggtgactagtccgtagggacagtactacacttctactactatcgagtcagcctgcacgtcctagtaagttntttagacttaaattttactacgttagtactaacttaagttaacttactaccgtaacccgtaggtacggttacgtccgggtacggaacggggactaagggtacggaaacttaccgaaaccggtatgggtcgngtggtaaccc

SEQ ID NO: 214249 - DNA, 515 bp, Homo sapiens
  misc_feature: GYAE6OF01DB806.1.34.D01.1.454.CMB.1.raw
  modified_base (282)..(282): a, c, t, g, unknown or other
  misc_feature (282)..(282): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggccgagcccctnagatcgtagtctatggtgcatccagattgcaagggtgggtcccatcccaggttcagtgcagtgcatctgggacagattacactctcactatcaagcagcctgcagctgaatntttgctaatttntactgtacaatattattatacgtaaccctaggtcggacgttccgggaccgtaagggggacccaaagggtacggaaagtacgtaaacccgaatcggtacggcttcgaccg

SEQ ID NO: 214250 - DNA, 602 bp, Homo sapiens
  misc_feature: GYAE6OF01BADR2.1.34.D01.1.454.CMB.1.raw
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctagttggagacagagtcaccatcacgttggcccgggcgagtcaggccatcagcgtattcttagcctggttgcagcaagaaaccgagggcgacgcccctnagatcgtagtctagtggtncatccagattgacgaaggtcgggtacccagtccgtaggttcaggtggcaggtcgacagtcgtagggactaagtattaccactcctacaacttatcagcacgcctgacncgtacctagaacgttatttagacttaatttactacgttcgtaactaacttagttaacttaacgtaaccgttaaccccgttagtaccgggtaccggtttaccgggaccggtacggggaaacctaacggggttacggtaaacggtaccgtaaacccggtacgttagggtcggtcgtaccggtaacccg

SEQ ID NO: 214251 - DNA, 393 bp, Homo sapiens
  misc_feature: GYAE6OF01B4LDP.1.34.D01.1.454.CMB.1.raw
  modified_base (383)..(383): a, c, t, g, unknown or other
  misc_feature (383)..(383): n is a, c, g, or t
  modified_base (388)..(393): a, c, t, g, unknown or other
  misc_feature (388)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctagtttattactgtcagcagttattatacgtacccctagtggacgttcggccaggggaccaaggtggaagtcaaccgaactgtgctgcaccatctgtcttcattccttcccgccctcctcacgcactcgtctgacgcgggctggccaaggcncatgnnnnnn

SEQ ID NO: 214252 - DNA, 465 bp, Homo sapiens
  misc_feature: GYAE6OF01DY5UZ.1.34.D01.1.454.CMB.1.raw
  modified_base (254)..(254): a, c, t, g, unknown or other
  misc_feature (254)..(254): n is a, c, g, or t
  modified_base (439)..(439): a, c, t, g, unknown or other
  misc_feature (439)..(439): n is a, c, g, or t
  modified_base (443)..(444): a, c, t, g, unknown or other
  misc_feature (443)..(444): n is a, c, g, or t
  modified_base (449)..(449): a, c, t, g, unknown or other
  misc_feature (449)..(449): n is a, c, g, or t
  modified_base (457)..(458): a, c, t, g, unknown or other
  misc_feature (457)..(458): n is a, c, g, or t
  modified_base (464)..(464): a, c, t, g, unknown or other
  misc_feature (464)..(464): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggtgcagcagaaaccagggcgagcccctnagatcgtagtctatggtgcatccagattgcaaggtgggtcccatccaggttcagtggcagtgcatctgggacagattacactctcactatcagcagcctgcagcctagaatatttgactaatttatactgtacaactagtattatacgtaccctagtgacgtgcgagggacagtgatcgacgtangtgnngcacntctgtctnntctccnc

SEQ ID NO: 214253 - DNA, 517 bp, Homo sapiens
  misc_feature: GYAE6OF01C9NLX.1.34.D01.1.454.CMB.1.raw
  modified_base (280)..(280): a, c, t, g, unknown or other
  misc_feature (280)..(280): n is a, c, g, or t
  modified_base (374)..(374): a, c, t, g, unknown or other
  misc_feature (374)..(374): n is a, c, g, or t
  modified_base (507)..(507): a, c, t, g, unknown or other
  misc_feature (507)..(507): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcagtcaggccatcagcgattcttagcctggtgcagcagaaaccgaggcgacgcccctnagatcgtagtctagtggtgcatccagattgctaaggtcgggtaccagtcccgaggttcagtggcaggtgcaatcgtgggacagattacactctnactatcagcagcctgcagcctagaacgtattttgactaatttattactgtacaacagtattacgtacgtaccctagtaggacgttcgggccgaaggggaccaagggtacggaaacgtacaaaccggactaggngtctgtaccg

SEQ ID NO: 214254 - DNA, 608 bp, Homo sapiens
  misc_feature: GYAE6OF01DIJSJ.1.34.D01.1.454.CMB.1.raw
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagatcaccatcacttggccgggngagtcaggccatcagcgtatttcttagccttggttgcagcaagaaccagggcgacgcccctnagatcgtagtctagtggtgcatccagattggacgtaagggtcggtccagtccgaggttcaggtgctaggtnctagtcgtagggacagtacttacactctacactatcagtcagcctgacacgaccttagaacgttattttagacttaattttacttacttagtaactaacgttaagttaactttacgtaacccggttaaccccgttacggtacgggttaaccggtttaccgggaccggtaagggggtaacccgtaaaggggttaccgggtaaaccgtaaccggtaaacccggtaaggttcggttacggtccgtcggtaacccg

SEQ ID NO: 214255 - DNA, 558 bp, Homo sapiens
  misc_feature: GYAE6OF01D3UB8.1.34.D01.1.454.CMB.1.raw
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattcttagcctggttgcagcagaaaccagggcgacgcccctcagatcgtagtctagtggtncatccagattggactaaggggtcgggtcccatccgaggttcagtcggcagtgcagtcgtagggacagtattacacttctacactatcagcacgcctgcagtcctaggaattattttgacttaaatttattacgtagttacctaaatagttattactaccgtaccccttaggtcgggtaccgttccgggaccgtagggggtaaccgaagggtacggaaacgtaacccggtaaaccgtaacgttgggtcggccgtgacccg

SEQ ID NO: 214256 - DNA, 575 bp, Homo sapiens
  misc_feature: GYAE6OF01DAK2Y.1.34.D01.1.454.CMB.1.raw
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctccccaggtaccagctgtgacatccaattgacccagtctccatcctccctgtctgcatctattgganacagagtcaccatcacttggccgggcgagtcaggccatcagcgtattctttagcctggttgcagcaagaaccngggcgacgcccctcagactcgtagtctagtggtgcatccgagtattgacgaagggtcgggtcccatccgaggttcaggtcggcagtgacagtcgtggactagtattaccacttctacacttatcagcagcctgcagcctagaagtnttttacgattaatttatactgtactaactagttaattagtaccgttaacccgttacggtacgggttaccgttaccgggaaccggtaacggggtaaccgtaaaggggtacggaaacgttaccgaaacccggtaaacgttggtacggccttacggaccc

SEQ ID NO: 214257 - DNA, 515 bp, Homo sapiens
  misc_feature: GYAE6OF01B5B4B.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccgagggccgagcccctcagatcgtagtctatggtgcatccagattgcaagggtcgggtcccatccaggttcagtggcagtgcatcgtgggacagattacactctcactatcagcagcctgcagcctagaagtattttgacttaatttattactgtacaatagttaattactacgttacccctagtcggtacgttcggccgtaggggacctaagggtggaaacgtacgaaaccgtactaggtggctggacc

SEQ ID NO: 214258 - DNA, 554 bp, Homo sapiens
  misc_feature: GYAE6OF01CBDOY.1.34.D01.1.454.CMB.1.raw
  modified_base (284)..(284): a, c, t, g, unknown or other
  misc_feature (284)..(284): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctgagntcgtagtctatggtgcatccagattgcgtaaggtcgggtccatccgaggttcaggtggcagtgcatcgtgggacagtacttacactctacactancagcagcctgcagcctagaagtntttacgacttaatttacttacgtagttactaacctaagttattaacgtaccgttacccccgtaggttacggtaccggttccgggacccgtaggggaacctaaggggtacggtaaagtacccgtaaaccggtattagggtacggctggtaccc

SEQ ID NO: 214259 - DNA, 401 bp, Homo sapiens
  misc_feature: GYAE6OF01AVWPG.1.34.D01.1.454.CMB.1.raw
  modified_base (383)..(401): a, c, t, g, unknown or other
  misc_feature (383)..(401): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcggccagggggaccaaggtggaagtcaaccgaatgtggctgcaccatctgtcttcatcttcccgcatctgaacgcactcgtctgacgcgggctggcaaggcgcatagnnnnnnnnnnnnnnnnnnn

SEQ ID NO: 214260 - DNA, 562 bp, Homo sapiens
  misc_feature: GYAE6OF01DKZ7Z.1.34.D01.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattctttagcctggttgcagcaagaaaccgagggcgacgcccctcagatcgtagtctagtggtgcatccagattgcaaggtgggtccagtccaggttcagtgcagtgcatcgtagggactagacttacactctacactatcagcagcctgcagccttagaagttattttgacttaaagtttattacgtagtacctaaactagttaatttacgtaaccgttaccccgttaaggtacgggtaaccgttccgggaccgaacgggggaacctaaaggggtacggaaacgttacgaaaccggtaacgtgggttacggccgttggaaccc

SEQ ID NO: 214261 - DNA, 585 bp, Homo sapiens
  misc_feature: GYAE6OF01C4TRM.1.34.D01.1.454.CMB.1.raw
  modified_base (101)..(101): a, c, t, g, unknown or other
  misc_feature (101)..(101): n is a, c, g, or t
  modified_base (149)..(149): a, c, t, g, unknown or other
  misc_feature (149)..(149): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccntcagctccgtggggctcctgctgctctggctcccaggtaccagctgtnacatcaaattgaacccagtcctccatccctccctgtctgcatctagtggagacagagtcaaccatcacttgccggnagtcaggccatcagcattcttagctgtgcagnaagaacgagggcgacgcccctnagatcgtatntagtggtncaatccaagtagttgacgaaaggggttcgggacccaagtccgagggttcaggtcgganaggtgacaatcgagggaacagaattaacactacacaatancganccaagcctagctagcctagaaattatttacgaattaatttaacgtatgtaactaaatagttaatttaagtaaccgttaaccccgtaaggtacgggtaccggttaccgggaccggaaggggaacccgaaaggggtacgggtaaacgtaaccggtaaacccgtaacgtggtacggtcgtccggaaccc

SEQ ID NO: 214262 - DNA, 398 bp, Homo sapiens
  misc_feature: GYAE6OF01C87WO.1.34.D01.1.454.CMB.1.raw
  modified_base (390)..(398): a, c, t, g, unknown or other
  misc_feature (390)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaacagtattatacgtacccctagtgacgttcggccaggggaccaaggtgaacgtcaaccgaactgtggctgcaccatctgtctcatctcccgctatctgaacgctactcgtctgacggcgggctggccaaggcgacatagnnnnnnnnn

SEQ ID NO: 214263 - DNA, 391 bp, Homo sapiens
  misc_feature: GYAE6OF01BELTA.1.34.D01.1.454.CMB.1.raw
  modified_base (311)..(311): a, c, t, g, unknown or other
  misc_feature (311)..(311): n is a, c, g, or t
  modified_base (382)..(391): a, c, t, g, unknown or other
  misc_feature (382)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaacagtattatagtacccctagtggacgttcggccaggggaccaaggtgaagtcaacgatgngctgcaccatctgtctcatcttcccgcctctcaccgcactcgtctgagcgggctggcaaggccgcagtagnnnnnnnnnn

SEQ ID NO: 214264 - DNA, 500 bp, Homo sapiens
  misc_feature: GYAE6OF01CYJXT.1.34.D01.1.454.CMB.1.raw
  modified_base (421)..(421): a, c, t, g, unknown or other
  misc_feature (421)..(421): n is a, c, g, or t
  modified_base (493)..(493): a, c, t, g, unknown or other
  misc_feature (493)..(493): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcgagcccctcagatcgtagtctatggtgcatccagattgcgaaggtgggtcccatccgaggttcagtggcagtgcagtcgtgggacagtattacgactctacactatcagcacgcctgcagcctagaatatttgactaatttattactntacaactattattatacgtaccctacgtggtacgttacggccgtagggactaagggcgaagtacaacgatgngctgacc

SEQ ID NO: 214265 - DNA, 417 bp, Homo sapiens
  misc_feature: GYAE6OF01AYPS9.1.34.D01.1.454.CMB.1.raw
  modified_base (387)..(387): a, c, t, g, unknown or other
  misc_feature (387)..(387): n is a, c, g, or t
  modified_base (405)..(417): a, c, t, g, unknown or other
  misc_feature (405)..(417): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctgaagtattttgactaatttattactgtcaaacagtattatacgtacccctagtggtacgttcggccaagggggaccaagggttggaacgtacaaccgtaactggtggctgcaaccatctgtcttcatccttacccaccctctcacgtcactcgtctgacgcggtntcggcaaggcgcagtagnnnnnnnnnnnnn

SEQ ID NO: 214266 - DNA, 801 bp, Homo sapiens
  misc_feature: GYAE6OF01C3SGE.1.34.D01.1.454.CMB.1.raw
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcacctatctacgttcggccgggcgacgtcacggccatcgagcgtatttcttacgcgttggtgcagcaagaaccgnggcgacgtccctgagatcgtagtctagtggtagcatccagtagttcgacggtaacggggtcggtacctagtccgtaggtttcgagggttcggacgtaggttcgaccgttaaggtccggtaggggtaactaacggtacttaacctacgttacctactaacgttactaccgacggaccgtaacgcccgttacggaccgtacgtacccggttaaggtaaacggtttttacgttttaccgaaactttttaacgtttttaaaccgtttaacccggtttaacgttaaacccgttaaagtttaaacggttttaaacgttttaacccggttaaaccccggtttaaacccccggtttaaggggttaccccgggtttaaacccggggttacccggggtaaaccccgggtaaagggggggttaaaaccccgttaaacgggggggttaaccggttaaaacccggttaaaccccgggtaaaacccgggtttaaccgttagggggttacccggtaaccgtttaacggaacccccggg

SEQ ID NO: 214267 - DNA, 390 bp, Homo sapiens
  misc_feature: GYAE6OF01CW272.1.34.D01.1.454.CMB.1.raw
  modified_base (349)..(349): a, c, t, g, unknown or other
  misc_feature (349)..(349): n is a, c, g, or t
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcggccaggggaccaaggtggaagtcaaaccgactgtggctgcaccatctgtcttcatcttcccgcatctgaacncactcgctgagcgggctggacaaggcgcaatagnnnnnnnn

SEQ ID NO: 214268 - DNA, 579 bp, Homo sapiens
  misc_feature: GYAE6OF01ET9LJ.1.34.D01.1.454.CMB.1.raw
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccgagggcgacgcccctnagatcgtagtctatggngcatccagtattgacgaagggtcgggtacccatccgaggttcaggtggacagtgactagtcgtagggacaagtattaccgactctacactatcagcacgctgcagtcctagaattatttgacttaatttacttacgtgtaactaactagttaattagtaaccgttacccgtacgggttcggtaaccggtttccgggaccggtaacgggggtaaccgtaaacggggttaacggaaacgtacccgaaaccggtaacggtggtacggtacgtcgaacccg

SEQ ID NO: 214269 - DNA, 704 bp, Homo sapiens
  misc_feature: GYAE6OF01EVHQ3.1.34.D01.1.454.CMB.1.raw
  modified_base (228)..(228): a, c, t, g, unknown or other
  misc_feature (228)..(228): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagacgagtgcgtcacgaccggtgctcgatttagatcgtctgtgttggggtttgggggagtcagaccctgtcaggacacagcattggacattgagggttcccgctcagctcctggggctcctgctgctctggctccagggtaccagctgtgactatccaattgacctagtctccatcctcctgtctgcatctattggagacgaggagtcaccatcacgttggccggngagtcaggcctatcagcgtactttctttagccttggttcgtcagcaagaaaccgagggcgacgcccctgagactcgtagtctagtggtncagtcgagtnttgacgtaagggtcggtaccagtccgtaggttcagttggactagtcgactaagtcgtagggaacacgtattactactctactaactatcaagctaacgctacgacacgtaccgtagtaaacgttagttttacgaacttaaacttttaacttaccgttacgttaactaaacgttaacggtttaaactttaacgttaaccccggtttaaaccccggttaaaccgggttaacccggggtttaacccggttttaccgggtaaacccgggtaaaccgggggtaaacccggtaaaacggggttaacgggtaaaacccggttaaacccggtaaaacccgggtaaaccggttagggtaacgggtaccggtaacggtaaacccccg

SEQ ID NO: 214270 - DNA, 682 bp, Homo sapiens
  misc_feature: GYAE6OF01DQ8HG.1.34.D01.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcattgccgggnagtcaggccatcagcgattctttagccttggttgcagcaagaaaccagggcgacgcccctnagatcgtagtctatggtgcatccagattgacgaagggtcgggtccagtcccgaggttccaggtggactagtgacagtcgtagggacaaggtattaaccacgttcctactaacgttaactccgaacgcctaaacggccccttagggaccctaacggtcccgttaaggtaaacgtttacgtttttagaacctttaaagtttttaacttaaccgttagttaaccgtaaacgttaagtttaattaaccgttaccgttaacccccgtttaacgggtaccggggttaacccggtttaccggggacccggtaaaggggggtaaaccccgtaaagggggttacgggtaaaaccggttacccgaaaaaccgggttaaccgttagggtacggttaccggtacgtaaccccg

SEQ ID NO: 214271 - DNA, 612 bp, Homo sapiens
  misc_feature: GYAE6OF01EFHFT.1.34.D01.1.454.CMB.1.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacgttgccgggcgagtcaggccatcagcgtattctttagcctggttgcagcaagaaaccngggccgacgcccctnagatcggtagtctagtggtgcatccagtattgcgaagggtcgggtacccagtccgaggttcaggtggacagtgctagtcgtagggacagtacttacgacttctactactactcgacgctacgcctgcctacgcctagtaacgttattttacgacttaattttaacttaccgtagtaccgtaaacttaagttacttaacgttaccgttaaccccgttagggttacggtaaccggtttaccggacccgggtaagggggtaacccgtaaaggggtaccggtaaacggtacccgtaaaaccggtacgtaggttacggtcgtcggtaaccc

SEQ ID NO: 214272 - DNA, 593 bp, Homo sapiens
  misc_feature: GYAE6OF01CMV9R.1.34.D01.1.454.CMB.1.raw
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattcgagacagagtcaccatcacttgccgggcagtcaggccatcagcgattcttagcctggttgcagcagaaaccngggcgacgcccctnagtatcgtagtctagtggtgcatccagtattgacgaagggtcgggtacccagtccgaggttcaggtggctagtgacagtcgtgggacagtacttacactctacactatcagcacgcctgccacgtcctagtaacgttattttacgacttaatttacttacgtacgtactaaacttagttaattacgttaaccggtaaccccgttaggtacgggttaaccggttaccgggacccggtaacgggggtaacccgtaaaggggtacggtaaacgttacccgtaaacccggtacgttaggtacggtcgtacggtaccc

SEQ ID NO: 214273 - DNA, 530 bp, Homo sapiens
  misc_feature: GYAE6OF01BC57A.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatcccaggttcagtggcagtgcatctgggacagattacactctcactatcagcagcctgcagcctgaagattttgactaatttattactgtacaactagtattactagtaacccctagtggtacgttcgggccaggggaaccaagggtacggaagtaccaaacccggtaacgtcggtacggctcggccaacccattcctgttcctttacacttcccgtttccccgtacccg

SEQ ID NO: 214274 - DNA, 677 bp, Homo sapiens
  misc_feature: GYAE6OF01CVSF8.1.34.D01.1.454.CMB.1.raw
  modified_base (199)..(199): a, c, t, g, unknown or other
  misc_feature (199)..(199): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattgacccagtctccatccctcctgtctgcatctagtgganacagacgtcacctatctacgtcggccgggacgtagtcacggccagtcgagcgtattcgttacgccgtggtgcagcaagaaccgngggccacgcccctgagactcgtacgtctagtgtgcatccgagtatgacgaggtcggtccatcgtagtcgagtcgcgagtgacgtacgtcgtagggactaagtactactacgtcctacacgtactacgacgtctacgtccgtacgtacgtacgtacgttaggtaaacgttcgtttttaacgaacttttaaacttttaagttccgttaacggttaacctaaacggttaagttttaacctttaacgggttaaccccttaaccccggtttagggtaaacccgggttacccggtttaccggggaaccccggtaaaaggggggtcccgttaaaagggggtcggtaaaacccggttacccgtaaaccggttaacgtcgggtaacggtccgtacgtaacccg

SEQ ID NO: 214275 - DNA, 558 bp, Homo sapiens
  misc_feature: GYAE6OF01BMALS.1.34.D01.1.454.CMB.1.raw
  modified_base (257)..(257): a, c, t, g, unknown or other
  misc_feature (257)..(257): n is a, c, g, or t
  modified_base (381)..(381): a, c, t, g, unknown or other
  misc_feature (381)..(381): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgcgaaggtcgggtcccagtccaggttcaggtggcagtgcagtcgtgggacagtacttacactctacactatcagcacgcctgcagcctagaagttntttagacttaatttattactgtacaactagttattacgtaccgtacccgtaggtcggtaccgttccggaccgtacggggtacctaagggtacggaacgtccgaaaccggtacgttggtcggtactcgccaccgtattccgttcggttaccttacgtacttcccgttccccgtacccc

SEQ ID NO: 214276 - DNA, 680 bp, Homo sapiens
  misc_feature: GYAE6OF01CVDZH.1.34.D01.1.454.CMB.1.raw
  modified_base (222)..(222): a, c, t, g, unknown or other
  misc_feature (222)..(222): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcagtctattggagacagagtcaccatcacttgccgggnagtcaggccatcagcgtattctttagcctggttgcacgcaacgaaaccgngggcgacgcccctanagatcgtagtcctaagtggtgcatccagtaattgacgtaacgggtcgggtaccccagttacccgtaagggtttccgaaggttcgggcctaaggttcgactaacgttccgtaggggaacctaggtaactttaaccaacgttccttacaaccttaagtccgtaacgtccagtcccgttggacctacggtacccttaggtaaacgttatttttacgggaactttaaagttttacgttaaccgttaggttacctaaaacgtagtttaacgtttagttaacccgttaaccccgttagggtacgggtaccggtttaccgggacccggtaaggggtaacccgttaaagggtacggtaaggttaccgtaaaccggtacgttggtacggtcgtcggtaaacc

SEQ ID NO: 214277 - DNA, 527 bp, Homo sapiens
  misc_feature: GYAE6OF01BODVP.1.34.D01.1.454.CMB.1.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaacngggcagcccctnagatcgtagtctatggtgcatccagattggcaagggtcgggtccccatcccaggttcaggtggcagtgctatcgtgggaccagtattacactctcactatcagcagcctgcagcctgaattnttttgacttaatttattactagtactaactagttattactacgtaccccctagtacgggtaccgttccgggacgaggggaaccgtaagggtcggaaagttaccgaaaccggtatggtggcgtcgaccc

SEQ ID NO: 214278 - DNA, 528 bp, Homo sapiens
  misc_feature: GYAE6OF01B5RB8.1.34.D01.1.454.CMB.1.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggccatcagcgattcttagcctggttgcagcagaaccngggcagcccctnagatcgtagtctatggtgcatccagattggcaagggtcgggtacccatccgaggttcaggtggcagtgcatcgtagggacagattacactctacactactcagcagcctgcagcctagtaacgttatttacgacttaattttacttactgtacaatagttacttataccgtaccctaggtggaccgttcgggaccgtaggggaaccctaagggtcggaaagtaccgaaccgtagtaggcggtcgtgaccc

SEQ ID NO: 214279 - DNA, 484 bp, Homo sapiens
  misc_feature: GYAE6OF01ENTAC.1.34.D01.1.454.CMB.1.raw
  modified_base (299)..(299): a, c, t, g, unknown or other
  misc_feature (299)..(299): n is a, c, g, or t
  modified_base (382)..(382): a, c, t, g, unknown or other
  misc_feature (382)..(382): n is a, c, g, or t
  modified_base (475)..(475): a, c, t, g, unknown or other
  misc_feature (475)..(475): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctatggtncatccagattgcaaggtgggtccatccaggttcagtggcagtgcatctgggacagattacactctcactatcagcagcctgcngctgaagtatttgactaatttatactgtacaactgtattatacgtaccctagtggacgttcggcaggggaccaaggtggaagtcaacgaatgnggctgaccg

SEQ ID NO: 214280 - DNA, 501 bp, Homo sapiens
  misc_feature: GYAE6OF01A6GQ9.1.34.D01.1.454.CMB.1.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (399)..(399): a, c, t, g, unknown or other
  misc_feature (399)..(399): n is a, c, g, or t
  modified_base (494)..(494): a, c, t, g, unknown or other
  misc_feature (494)..(494): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcagcccctnagatcgtagtctatggtgcatccagattgcaagggtcgggtcccatccaggttcaggtggacagtgcatcgtgggacagtattacactctcactatcagcagcctgcagcctagaactntttgactaatttatactgtacaaactagtaattatacgtaccctaggtcggtacgttccggaccgaggggaccaggtaggaagtacgaacgatgngctgacc

SEQ ID NO: 214281 - DNA, 743 bp, Homo sapiens
  misc_feature: GYAE6OF01C6O68.1.34.D01.1.454.CMB.1.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgtattcttagcctggttgcagacaagaaaccgagggcgacgcccctnagactcgtagtctagtggtcgctatccgagtattggacgtaaggggtcgggtaccccagttacccgaggttcaggttcggactaggtcgctagtcggtacggggaactaggtacttaccgaccttactacgtaacttattccgaacgccgtaagtcccgtaggacctacggtacccttaagggtaaacgtttaacgttttttccggaacttttaaacgttttttaacgtttaacccgttagttaaacctaaacgtttaacgttttaacgtttaaccgttaacccggttaaacccccgtttagggttaaccgggttaaccccggtttacccggggtaaacccgggtaaaccgggggggtaacccgttaaaggggggttaaccggttaaaaccggttaaccccggtaaaacccgggttaaacgttggggttaacccgggtaccttccgggtaaaaccccg

SEQ ID NO: 214282 - DNA, 763 bp, Homo sapiens
  misc_feature: GYAE6OF01CIQ81.1.34.D01.1.454.CMB.1.raw
tcagacgagtgcgtcacgaccggtgctcgatttagatcgtctgtgttggggtttgggcgatcggacatgagggtccccgcgtcgagtcctcctggggctcctgctgctctaggctcccaggtaccagctgtgactagtccaattgaccctaggttcctcctatcctccttagtctgccatctattggagacagagtcaccgagtcggacttggcccgggcgagtcgagggcccagtcaacgtcgtactttcgtttagcctgggttcgccaggctaacggaaaaccccgtaggggaccgtaacgcccccgtgtaacggacttaccggttagggtcctaacgtcgggtcgaccgaacgttcccgaaggtactttgggaccgtaaggggttccggggtccctaagtcccgttagggtttccaaggttcggacgtaaggtgcgtaatcgtaggaactagtaactacgacttcgacgtactaacgtcaacgtcaacgtccctaggacctaacgtacccttaaggaaacgttaacgttttacgaacgtttaaacttttaacgttaccttaggtaaccctaaacgtacggtttaacttaaacgttaccggttaaaccccgtttaagggtacggtaaccggtccggtaaccggtaacggggtaaccttaaagggttcggaaacggttaacgaaaaccgggtaacggttggtacgggacttacggcctaccgacttaccgtacgttctttacgtccttaccgttcccgaacg

SEQ ID NO: 214283 - DNA, 533 bp, Homo sapiens
  misc_feature: GYAE6OF01ET4ID.1.34.D01.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggttgcagcagaaaccngggcgacgcccctgagatcgtagtctatggtgcatccagtattgcgtaagggtcgggtccatcccgaggttcaggtggcaggtgctatcgtgggacagtattacactctcactatcagcagcctgcagcctagaacgtatttcgacttaatttactactgtactaactagttattatacgtacccgttagtacggaccgttcggaccgtaggggaacctaagggtacggtaacgtacgtaaaccgtacgtaggtcggtctggtacc

SEQ ID NO: 214284 - DNA, 732 bp, Homo sapiens
  misc_feature: GYAE6OF01AFLLU.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaccgagggcagcccctnagatcgtagtctatggtgcatccagtattggacgtaagggtcgggtcccaagtccgaggttcaggtggctaggtcgactagtcgtaggggacaaggtactttaccacgttcctaccgtaacttacgtacgaagcctaacggccccttaggaccgaacgtacccgttaggtaaacgtttactttttacggaacctttaaagtttttaactttaaccggttacgtttaaacccgtaaacgttaacgggtttaactttaaacgttaaccccggtttaaacccccggtttaacgggttaccggggttaaaccccgggttttacccgggggaacccgggttaaaccgggggggaaacccgttaaagggggttacccggggtaaaaccgttacccggaaaaaccccggggtttaacgttaccggggttacgggtaaccgttaccgggtaaacccccg

SEQ ID NO: 214285 - DNA, 403 bp, Homo sapiens
  misc_feature: GYAE6OF01CGM2T.1.34.D01.1.454.CMB.1.raw
  modified_base (388)..(388): a, c, t, g, unknown or other
  misc_feature (388)..(388): n is a, c, g, or t
  modified_base (390)..(403): a, c, t, g, unknown or other
  misc_feature (390)..(403): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgactaattttattactgtacaaacagtattatacgtacccctagtggacgttcggccaggggaccaaggtgaagtcaaccgatgtggctgcaccatctgtcttcatccttcccgcatctgaacgcactcgctgagcgggctggcaaggcgacaatagnannnnnnnnnnnnnn

SEQ ID NO: 214286 - DNA, 717 bp, Homo sapiens
  misc_feature: GYAE6OF01DFGOI.1.34.D01.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatggagggtcccccgctcagctccgtggggctcctgctgctctggcctcccaggtaccagctgtgacatccaattcgacccagtcctccactccctccctgtctgcattctatgganacagatcaccatcacttggccgggnagtcaggccatcagcgtattctttacgccttggtcgcagcgaacgaaaccgagggccgacgcccctgagtactcgtagtctagtcggtnactactccgagtagttcgacggtaacggggtcggtacccagtccgaggttcaggtcggctagtcacgtagtcgaggactagtactacgacttcgactacgtatcgacgaccgacgtcccgtagacctacggtaccgttaaggttaagttttacgtttaacgtaacttttaacgtttttaacttaccggttaacgtaaaccgttaaacgttaacggttttaaactttaacccgggtaaaccccggtttaccccggttaacggggttcccgggttaacccgggtttaccggggaaacccgggttaaacgggggaacccgttaaaagggggttaacggtaaaacccggtaccgggtaaaacccggttaacgggttccggaagggtcccgtacggtaacccc

SEQ ID NO: 214287 - DNA, 610 bp, Homo sapiens
  misc_feature: GYAE6OF01DVJ2O.1.34.D01.1.454.CMB.1.raw
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (540)..(540): a, c, t, g, unknown or other
  misc_feature (540)..(540): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (570)..(570): a, c, t, g, unknown or other
  misc_feature (570)..(570): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (608)..(608): a, c, t, g, unknown or other
  misc_feature (608)..(608): n is a, c, g, or t
tcagacgagtgcgtcacgaccggtgctcgatttagatcgtctgtgttgggtttgggagtcaggccatctagcgattctttagtacctggttgcagcagaaaccagggcgagcccctcagagtcgtagtctatggtgcgactccagattgcaaggtgggtcccatccaggttcagttggtcagtgcatctgggacagattacgactctcactatcgaggcagcctgcagcctgaagtattttggactaattttattactgtactaaactagtaattatacgtaccccgtaggtcggtaccgttccggcctaagggggaccaaagggttcggaaacgttaccaaacccggaacgttggtacggaccttaggacctaaccgtaattcctagtcctttacaacttcccgttccccgactaagttcccgttaggaaacccggtcctaaccgttccggttacgtaggtaacggtcggggtctacggggaccaaaggggtcccacgtaaagttacggactactggtntntntntntgtgacgagagngcgtacncgtctctcncgacncacgacgcncgtctcgtccgtcgcgtcncncacgtcgacacncncgngc

SEQ ID NO: 214288 - DNA, 612 bp, Homo sapiens
  misc_feature: GYAE6OF01DP63U.1.34.D01.1.454.CMB.1.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtggttggggtttgggggagtcagaccctgtcaggacacagcatggacatgagggtccccgctcagctccgtggggctcctgctgctctggctcccaggtaccagctgtgacatccaattgacccagtctccatcctccctgtctgcatctattggagacagagtcaccatcacttgccgggcagtcaggccatcagcgtatttcttagcctggttncagacaagaaccngggcgacgcccctnagtatcgtagtctagtggtncactccagtattcggacgtaacggggtcgggtacccaagttccgaaggtttcaaggtggactaggtcgactagtcggtagggaactaggtactttaaccgaccttctacgtaactagtcaacggcacgtccctgaccagtacctagtaacgttattttgaacttaattttactactagtaccaattagttattacgaccgttacccgtaggtacggtaccgttacgggaccggtaaggggaaccgtaaggggtacggtaaacgtacccgtaaaaccgggtaacgtgggtacggtcgttgaaccccg

SEQ ID NO: 214289 - DNA, 518 bp, Homo sapiens
  misc_feature: GYAE6OF01A6WKN.1.34.D01.1.454.CMB.1.raw
  modified_base (282)..(282): a, c, t, g, unknown or other
  misc_feature (282)..(282): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagtattgcgtaagggtcgggtcccagtccgaggttcagtggcagtgcagtcgtgggacagtattacactctcactatcagcagcctgcagcctagaagtntttagactaatttatactgtacaatagttaattatacgtacccttaggtcggtacgttcggccaggggaccaagggtcggaagtaccgaaaccgaacgttggtggtctggacc

SEQ ID NO: 214290 - DNA, 396 bp, Homo sapiens
  misc_feature: GYAE6OF01C1SPY.1.34.D01.1.454.CMB.1.raw
  modified_base (384)..(384): a, c, t, g, unknown or other
  misc_feature (384)..(384): n is a, c, g, or t
  modified_base (390)..(396): a, c, t, g, unknown or other
  misc_feature (390)..(396): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaattttattactgtcaacagtattatagtacccctacgtggacgttcggccagggggaccaagggtggaagtcaaccgaactgtggctgcaccatctgtcttcatcttcccgccatctgaacgcactcgtctgagcgggctggccaagggcncatagnnnnnnn

SEQ ID NO: 214291 - DNA, 660 bp, Homo sapiens
  misc_feature: GYAE6OF01DWK6H.1.34.D01.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattcgacccagtctccatccctcctgtctgcatctatgganacagatcaccatcacttggccgggnagtcaggccagtcagtcgtattcttagccttggttgcagacaagaaaccgagggcgacgcccctgagtactcgtagtctagtggngcatccagtacttgacgtaacgggtcgggtcccagtccgaggttcaggtcggctaggtcgactagtcggtagggactagtacttaccacttactactaactatacgagccgaacgcctgacctacgtcctaggtaaacgttattttacgaactttaaactttagttacctacgttaactaaacgttagttaactttaaccgttaaccggttaacccccttaagggttaccgggtaacccggtttaccgggaacccgggtaaacgggggtaaacccggtaaaggggttaaccgggtaaaccggttaacccgaaaacccggttacggtgggttaacgggccttaaccggaaccc

SEQ ID NO: 214292 - DNA, 500 bp, Homo sapiens
  misc_feature: GYAE6OF01EWCMS.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtcgggtccatccaggttcagtggcagtgcatcgtgggacagattacactctcactatcagcagcctgccagcctagaagtattttgactaatttatactgtacaatagttatatacgtaccctagtacggtacgttcggaccgaggggaccaagggtcggaagtacgaaccgtatgtggctgacc

SEQ ID NO: 214293 - DNA, 584 bp, Homo sapiens
  misc_feature: GYAE6OF01D3NCJ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctagtggtgcatccagtattgacgtaacggggtcggggtaccccagtcccgagggtttccaaggtgggctaggtgctagtcgtaggggacaggtacttacacctctacacttatcagcacgcctgcagtcctagaacgttatttcgacttaatttattacgtgtactaactagttaattacgtacgttaaccccgttaggtcggtacggttccgggaccggtacgggggaaccctaaggggtacggtaaacgtacccgtaaaccggtaacgttggtcggtcctcggaacccg

SEQ ID NO: 214294 - DNA, 391 bp, Homo sapiens
  misc_feature: GYAE6OF01EDM9R.1.34.D01.1.454.CMB.1.raw
  modified_base (379)..(379): a, c, t, g, unknown or other
  misc_feature (379)..(379): n is a, c, g, or t
  modified_base (385)..(391): a, c, t, g, unknown or other
  misc_feature (385)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattatagtacccctagtggacgttcggccagggggaccaaggtggaagtcaaccgaactgtggctgcaccatctgtcttcatctcccaccctctcacgcactcgtctgagcggctgggcaaggcncatagnnnnnnn

SEQ ID NO: 214295 - DNA, 641 bp, Homo sapiens
  misc_feature: GYAE6OF01C2WNZ.1.34.D01.1.454.CMB.1.raw
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctattggagacagagtcaccatcacgttggccgggngagtcaggccatcagcgtatttcttagcctggtncagcaagaaccgnggcacgcccctnagntcgtatctagtggtcncatcagtattcgacgtaacgggtcggtacccagtaccgaggtttcaggtcggacgtaggtcgactagttccggagggaactaggtactttaaccgaccttctaccaacttacgtcgaacgtccaacggccttacggaccgtacgtacccgttaaggtaactttacgttttacgaactttaaagtttttacctaacgttacgttaactaaaccgttagtttaaccttaacgttaacccggttacccgttacgggtaccgggtaccggttaccgggaaccggtacgggaaccggtgggttaacgacgttaaccgaacgtacgtggtcgacgttcgacc

SEQ ID NO: 214296 - DNA, 535 bp, Homo sapiens
  misc_feature: GYAE6OF01DSD8O.1.34.D01.1.454.CMB.1.raw
  modified_base (270)..(270): a, c, t, g, unknown or other
  misc_feature (270)..(270): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccgngggcgacgcccctcagactcgtagtctagtggtgcatccagattgacgaagggtcgggtcccagtccaggttcaggtggcaggtgctatcgtagggacagtacttacactctacactatcagcagcctgcagtcctagtaacgtnttttgacttaattttatacttagtacaatagttaatttactaacgttacccgtaggtcggtacgttcggaccgtaggggaccaagggtaggaactacgaaccgtatggtcggctgtaccc

SEQ ID NO: 214297 - DNA, 536 bp, Homo sapiens
  misc_feature: GYAE6OF01C6NH3.1.34.D01.1.454.CMB.1.raw
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagacagaaaccngggcacgcccctnagactcgtagtctagtggtncatcagattgacgtaaggtcgggtaccagtccgaggttcagtggcgtagtgcagtcgtgggacagacttacactctcactatcagcagcctgacacgcctagtaagtattttgattaatttactactagtacaactagttaattactaccgtacccgtaggtcggtacgttcggacggtaagggaacgtaaggtacggtaacgtaccgtaaaccggtagttggacgcgtcgacc

SEQ ID NO: 214298 - DNA, 489 bp, Homo sapiens
  misc_feature: GYAE6OF01A4TLZ.1.34.D01.1.454.CMB.1.raw
  modified_base (394)..(394): a, c, t, g, unknown or other
  misc_feature (394)..(394): n is a, c, g, or t
  modified_base (486)..(486): a, c, t, g, unknown or other
  misc_feature (486)..(486): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtnttttgactaatttatactgtacaactagtattatacgtaccctagtcggacgttcggccgtaggggaccagggtgaagtcaaccgactgtgntgc

SEQ ID NO: 214299 - DNA, 520 bp, Homo sapiens
  misc_feature: GYAE6OF01EUNRM.1.34.D01.1.454.CMB.1.raw
  modified_base (102)..(102): a, c, t, g, unknown or other
  misc_feature (102)..(102): n is a, c, g, or t
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttggccgggnagtcaggccatcagcgattcttagcctggttgcagcagaaaccngggcgacgcccctnagatcgtagtctatggtncatccagtattgacgaaggtcgggtacccatccgaggttcagtggcagtgcatcgtgggacagtattacactctacactatcagcacgcctgcagtctagaatgtttgactaatttactactgtacaactagtattactacgtaccctaggtcggaccgttcggaccgtaggggacctaagggtacgaacgtaccgaaaccgtacgtaggtcggctgaccg

SEQ ID NO: 214300 - DNA, 592 bp, Homo sapiens
  misc_feature: GYAE6OF01EZALU.1.34.D01.1.454.CMB.1.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctattggagacagagtcaccatcacgttcggccgggcgagtcaggccatcagcgtatttcttagcctggttgcagcaagaaaccgagggcgacgcccctanagatcgtagtctagtggtncatccagtattggacgtaagggtcgggtacccagtccgaggttcaggtcggctagtcgctagtcgtagggactagtacttaccacttctactaacttatacgacgcacgtcctgacacgtacgtagtaagtttatttgacttaattttactacgttagtaactaatagttaattacgtaccgttaaccccgtaggttcggtaccggtttacgggacccggtaaggggaaccgtaagggtacggaaacgtaccgaaaccggtactaggtcggtcgtcggtaacc

SEQ ID NO: 214301 - DNA, 560 bp, Homo sapiens
  misc_feature: GYAE6OF01A68JU.1.34.D01.1.454.CMB.1.raw
  modified_base (267)..(267): a, c, t, g, unknown or other
  misc_feature (267)..(267): n is a, c, g, or t
  modified_base (355)..(355): a, c, t, g, unknown or other
  misc_feature (355)..(355): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccngggcacgcccctgagatcgtagtctagtggtgcatccagtattgcaagggtcgggtcccagtccgaggttcaggtggcagtgcatcgnggacagtattacactctcactatcagcagcctgcagcctagaatatttgacttaattttacttactcgtactaactaagttattacgtaacgtacccttaggtcggtacggtttaccgggaccgtaacggggaaccgtaaggggtacggtaaaccggttaccgtaaaacccggttaacgttagggtacggtccgtcggtaacccg

SEQ ID NO: 214302 - DNA, 509 bp, Homo sapiens
  misc_feature: GYAE6OF01BNZLV.1.34.D01.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (474)..(474): a, c, t, g, unknown or other
  misc_feature (474)..(474): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatccctccctgtctgcatctattggagacagagtcaccatcacttgccgggcgagtcaggccatcagcgattctttagcctggtncagcagaacaggcagcccctnagatcgtagtctatggtgcatccagattgacaagggtcgggtcccatccagggttcagtggcagtgcatcgtgggacagtacttacactctcactatcagcagctgcagcctgaagtatttgacttaatttattactgtacaactagttaattatacgtaaccctaggttcggacgttcggacaggggaccaaggtcggaaatccgaacgaagtggtacggntagccaacctatcgtctcttacactcctcccgtac

SEQ ID NO: 214303 - DNA, 395 bp, Homo sapiens
  misc_feature: GYAE6OF01EUYSD.1.34.D01.1.454.CMB.1.raw
  modified_base (353)..(353): a, c, t, g, unknown or other
  misc_feature (353)..(353): n is a, c, g, or t
  modified_base (388)..(395): a, c, t, g, unknown or other
  misc_feature (388)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtcaacagtattatacgtacccctagtggacgttcggccaggggaccaaggtggaagtcaaccgaactgtggctgcaccatctgtcttcatctcccgcatctgaacncactcgtctgacgcgggctggcaaggcgacatagnnnnnnnn

SEQ ID NO: 214304 - DNA, 561 bp, Homo sapiens
  misc_feature: GYAE6OF01BL2OD.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttgccggcagtcaggccatcagcgtattctttagcctggttgccagacaagaaaccgagggccgacgccccctagacgtatcgtagtctagtggtgcaatccgagtagtttgacgtaagggtcgggtcccatccgaggttcagtggcagtcgactagtcgtagggacagtattaccacttctactacttatacagacacgtcctagcacgtcctagaacgttactttgacttaaagttttatactgtactaaactagttaacttactaccgtaccccgttaggtcggtaccgtcggacgaaggggtacctaagggtacgaactacgaaccgtacgtagtgcctggacc

SEQ ID NO: 214305 - DNA, 392 bp, Homo sapiens
  misc_feature: GYAE6OF01BK8ZI.1.34.D01.1.454.CMB.1.raw
  modified_base (380)..(380): a, c, t, g, unknown or other
  misc_feature (380)..(380): n is a, c, g, or t
  modified_base (386)..(392): a, c, t, g, unknown or other
  misc_feature (386)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctacgtggacgttcggccagggggaccaaggtggaagtcaaccgaactgtggctgcaccatctgtcttcatcttcccgccatctgaacgcactcgtctgagcgggctggcaggcncatagnnnnnnn

SEQ ID NO: 214306 - DNA, 504 bp, Homo sapiens
  misc_feature: GYAE6OF01EBID6.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctctatcctccctgtctgcatctattggagacagagtcaccatcacttgccggcagtcaggccatcagcgattcttagcctggttgcagcagaaaccagggcgacgcccctcagatcgtagtctatggtgcatccagattgcaaggtgggtcccatcccgaggttcaggtggcagtcgcagtcgtgggacagtattacactctcactatcagcagcctgcagctgaagtatttagactaatttattactgtacaactataattatacgtaccctacgtcggacgttcggaccgagggaaccaaggtacggaagtacgtaaccgaagtgtggctgacc

SEQ ID NO: 214307 - DNA, 559 bp, Homo sapiens
  misc_feature: GYAE6OF01BELH0.1.34.D01.1.454.CMB.1.raw
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggngagtcaggccatcagcgtattcttagcctggttgcagcaagaaaccgngggccgacgcccctcgagactcgtagtctagtggtgcatccagtattgacgaagggtcgggtcccagtccgaggttcaggtggctaggtcgcgtagtccgtagggaactagtaatttaccacttctacaactatacagcacgtcctagccagtcctagaattatttgacttaatttacttacgtntacaatagttatactacgtacccgtaggtcggtaacgttcggaccgaaggggtacctaagggtacgtaaacgtaccgaaccggacgtaggtcggcgtcgaccg

SEQ ID NO: 214308 - DNA, 598 bp, Homo sapiens
  misc_feature: GYAE6OF01D0WTA.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccgagggcgacgcccctcagatcgtagtctatggtgcatccagattgacgaagggtcgggtcccagtccgtaggttcaggtcggcgagtgctagtcgtagggactagtacttaccactctcaactatcagcacgcctagcagtcctagtaagtattttagacttaattttacttacgtagtacaacttaagttaacttacgttaaccgttacccccgttaaggtccgggtaaccggtttcccgggaccggtaaacgggggaacccgtaaagggggttacggtaaaccggtaccgtaaaaccccgggtacgtaggttcgggcttcggaacccg

SEQ ID NO: 214309 - DNA, 576 bp, Homo sapiens
  misc_feature: GYAE6OF01CMDMR.1.34.D01.1.454.CMB.1.raw
  modified_base (271)..(271): a, c, t, g, unknown or other
  misc_feature (271)..(271): n is a, c, g, or t
  modified_base (425)..(425): a, c, t, g, unknown or other
  misc_feature (425)..(425): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttacgcctggttgcagcaagaaaccgngggacgacgcccctcagatcgtagtctagtggtgcatccagtattgacgaaggttcgggtacccatccgaggttcaggtggacagtgcagtcgtagggactagtacttacactctacactatcacgtcacgcctagcacgtccgtagaacgttnttttagacttaatttacttactacgtactaactagttaacttacttaccgtaccccgttaggtacgggtaccgttaccgggaccgtaacggggtaacctaaggggtacgtaaacgttaccgaaaccggtacgttggtaccgtgtacgaccg

SEQ ID NO: 214310 - DNA, 396 bp, Homo sapiens
  misc_feature: GYAE6OF01B2VSQ.1.34.D01.1.454.CMB.1.raw
  modified_base (325)..(325): a, c, t, g, unknown or other
  misc_feature (325)..(325): n is a, c, g, or t
  modified_base (389)..(396): a, c, t, g, unknown or other
  misc_feature (389)..(396): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtacaacagtattatacgtacccctaggtggacgttcggccaggggaccaaggtggaagtcaacgaactgtggctgcacntctgtctcactcctcccgcatctgaacgcactcgtctgacgcgggctggacaagggcacatagnnnnnnnn

SEQ ID NO: 214311 - DNA, 580 bp, Homo sapiens
  misc_feature: GYAE6OF01DTSQD.1.34.D01.1.454.CMB.1.raw
  modified_base (102)..(102): a, c, t, g, unknown or other
  misc_feature (102)..(102): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctcctgtctgcatctattggagacagagtcaccatcacttggccgggcagtcaggccatcagcgtattctttagccttggttgcagcaagaaaccaggggcgacgcccctnagatcgtagtctagtggtgcatccagtattgacgaaggtcgggtcccagtccgaggttcaggtggcagtgctatcgtagggacagtacttacgactctacgactatcagcacgcctagcacgtcctagtaagttattttggacttaaattttactaacttgttaaccaaacgttagttaattacgtaaccgttaaccccgtaggtacggtaccgtttccgggaccggtaaggggtaaccgtaagggtacgggtaaacgtaccgaaaccggtaacttgggtacgcgttcggaaccc

SEQ ID NO: 214312 - DNA, 827 bp, Homo sapiens
  misc_feature: GYAE6OF01EIDPM.1.34.D01.1.454.CMB.1.raw
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagtggagacagacgtaccaacctactcctacgttcgggcccgggacgtacgtcgacggcctatcgagcgttactttcttacgtccgttggttcgcagacgaaacgaaaacccggngggaccgaccgtccccctagaagtacgttccggtagttctagtcgggtcgactactccgagtagttcgacggtaaggggttccggtaccctacgtaccggtaggttacgagggtcggactaggtcgacttacgtcggtaggggaactaggttaacttaccaccgttactaccgtaaacttacgtaccgaacgtaccgtaaccggtcccgtacggaccgtacggttacccggttaaggttaaacggttttacgtttttacggtaaactttttaaaacgtttttaacttaaccgttacgttaaacccgtaaaagtttaacgttttaaacgtttaacccgtttaacccgggttaaacccccgttaaggggttacccggggtaaccggttttacccccggggaaccgggtaaacggggggttaaacccggtaaaagggggtttaaaccgggtaaacccgttaaaccccgggaaaacccggtttaaccgggttagggttaaccgggttcccgtaccggtaaaccccg

SEQ ID NO: 214313 - DNA, 508 bp, Homo sapiens
  misc_feature: GYAE6OF01B46AJ.1.34.D01.1.454.CMB.1.raw
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctcagatcgtagtctatggtgcatccagattgcaaggtgggtcccatccaggttcagtggcagtgcatctgggacagattacactctcactatcagcagcctgcagcctagaagtnttttgactaattttatactgtacaactagttattatacgtaccccttagtcggacgtttcgggccgtagggggaaccaagggtacggaaatcgaaacgaactaggtcggctggacc

SEQ ID NO: 214314 - DNA, 509 bp, Homo sapiens
  misc_feature: GYAE6OF01AP5CY.1.34.D01.1.454.CMB.1.raw
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcacgcccctcagatcgtagtctatggtgcatccagattgcaaggtcgggtccatccaggttcaggtggcagtgcatcgtgggacagtattacactctacactatcagcagccctgcagcctagaagtnttttgacttaatttactactgtacaactagttatactacgtacccctagtacggtaccgttcggccgtagggaccgtaggtacggaagtccaaacgtatggcgtctgaccg

SEQ ID NO: 214315 - DNA, 386 bp, Homo sapiens
  misc_feature: GYAE6OF01B0HTC.1.34.D01.1.454.CMB.1.raw
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (383)..(386): a, c, t, g, unknown or other
  misc_feature (383)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtcaacagtattatagtacccctagtggacgttcggccaggggaccaaggtggaagtcaaccgaactgtggctgcaccatctgtctcatcttcccgccctctcacgcactcgtctgagcggntggcaaggcncatgnnnn

SEQ ID NO: 214316 - DNA, 680 bp, Homo sapiens
  misc_feature: GYAE6OF01AECCQ.1.34.D01.1.454.CMB.1.raw
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (491)..(491): a, c, t, g, unknown or other
  misc_feature (491)..(491): n is a, c, g, or t
tcagacgagtgcgtcacgaccggtgctcgatttagatcgtctgtgttgggtttgggggtaggtcgagaccctgtcaggacacagcatggacatgagggtccccgctcaggctcctggggctcctgctgctcgtggctcccgaggtacccagctgtgacatccaattgacccagtctccatcctccctgtctcgctaatctattggagacagagtcaccatcattcgccgggcagtcaggccatcagcgattcttagcctggtgcagcagaaaccngggacgacgcccctcacgntacggtagtctagtcggtagctacgtccagattgacgtaagggtcggggtacccagtccgaggttcgacggtgggtctaacgggtgtcccgtaaggttcgtaacgggggacctaaaggtactttaacaaccgttccgtacgtaaccttagtaccgacgtaccaggcccttagaccgacgtacccgtaggaacggttnttttacggacttaagttttacttacgtcgtaacaacgttattaactttaacgtccgttaaaccccgtggttaccggtaacgggtttacccggtaccggaacggggggtaaccgtacgggggtttaacggaaacgttaaccccgtaacccgggtaaccgttagggttccgggttaacgcccggtaaaacc

SEQ ID NO: 214317 - DNA, 556 bp, Homo sapiens
  misc_feature: GYAE6OF01EV6L6.1.34.D01.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccgagggcgacgcccctnagatcgtagtctatggtncatccagattgcgaagggtcggtccagtccgaggttcaggtggcagtcgcatcgtgggacagtattaaccactctcaactatcagcagcctgctacgcctagtaatntttagacttaatttacttactgtactaaactagttaattactacgtacccttaggtacggtaaccggtttccggaccgtaaggggaacccgtaaaggggtcgggtaaacgtaccgaaaaccggtacgttggtacggtctcggaccg

SEQ ID NO: 214318 - DNA, 421 bp, Homo sapiens
  misc_feature: GYAE6OF01A3MTR.1.34.D01.1.454.CMB.1.raw
  modified_base (396)..(396): a, c, t, g, unknown or other
  misc_feature (396)..(396): n is a, c, g, or t
  modified_base (404)..(405): a, c, t, g, unknown or other
  misc_feature (404)..(405): n is a, c, g, or t
  modified_base (407)..(421): a, c, t, g, unknown or other
  misc_feature (407)..(421): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacaacagtattatacgtaccctagtggacgttcggccaggggaccaaggtcggaagtaccgaaccgaacgtgtggctcgcaccatctgtcttcattccttcccgccatctagaacgcactcgtctgagcgggctgggacaagggcgnaagtacgnngnnnnnnnnnnnnnnn

SEQ ID NO: 214319 - DNA, 630 bp, Homo sapiens
  misc_feature: GYAE6OF01DLEID.1.34.D01.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcagcgtattcttagcctggttgcagcagaaaccagggcacgcccctnagatcgtagtctatggtnctataccgagattcggactaaggggttcgggtacccagtccctaggttcaggtcggacaggtgactagtcgtgggacagtaactttaccgaccttctacaacttatacgacgtcacgcctgaccacgtccgtagtaacgttattttgaacttaattttacgttaaccttacggttaactaaacgttaagtttaactttaacgttaacccgtaaaccccgttagggtaccggttaccgggtttaccgggacccgggtaagggggtaaccctaaaggttacgggttaacgggaaacgttacccggaaaaccggtagttcgggtgtccgttaccg

SEQ ID NO: 214320 - DNA, 723 bp, Homo sapiens
  misc_feature: GYAE6OF01BU5U6.1.34.D01.1.454.CMB.1.raw
  modified_base (103)..(103): a, c, t, g, unknown or other
  misc_feature (103)..(103): n is a, c, g, or t
  modified_base (327)..(327): a, c, t, g, unknown or other
  misc_feature (327)..(327): n is a, c, g, or t
tcagacgagtgcgtcacgaccggtgctcgatttagatcgtctgtgttgggtttgggggagtcagaccctgtcaggacacagcatggacactgagggtccccgntcagctcctgggctcctgctgctctggctcccaggtaccagctgtgacatccaattgacccagtctccactcctcctgtctgcatctattcggacacagagtcaccatcacttcggccgggtgagtcaggccatcagcgtattcgtttacgccgttggttcgactagccgaagaaaccgacggggaccgacgcccctcgagtacgttcgtagtctagtcggtcncgactccgaggtattcggacgtaaggggtcgggtacccagttcccgtaaggttcgaggtcgggcgtaacggtcgactacgtcggtacgggtactaacggtaactttaccgaccgttaccgtaactaacgttaactaccgaacggtaccgtaaccgtccgtacggaccgtacgtacccgttaggtaaacgtttagtttttacgacgttttaaactttttacgttacccgtttacgttaacccgttaaattaacgtttaacttttaaccgtaaccgtttaaccccggttacgggttacgggtaacccggttccgggaaccggttaacggggaaccgtaaacggggtacggaaacgttacccgtaaaccggtacgttaggtaccgtccgtcggtaaccc

SEQ ID NO: 214321 - DNA, 639 bp, Homo sapiens
  misc_feature: GYAE6OF01EY8OT.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcaaggaaaccagggcgacgcccctnagatcgtagtctatggtgcatccagattgcgaaggggtcgggtacccagtccgtaggttcaggtggctaggtgctagtcgtagggactagtacttacactctacactatcagccacgccctgcctacgtccgttagaacgttattttacgactttaattttaattaccgttagttaacctaaacgttaagttaactttaacgttaacccggttaacccccgttacgggttaccgggtaaccggttttcccgggaaccggtaaacgggggtaacccggtaaaggggttacgggtaaaccgttacccgtaaaacccgggttaacgttggggttacggtaccgttccggtaaccccg

SEQ ID NO: 214322 - DNA, 581 bp, Homo sapiens
  misc_feature: GYAE6OF01DEH6Z.1.34.D01.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (360)..(360): a, c, t, g, unknown or other
  misc_feature (360)..(360): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctatgganacagagtcaccatcacttgccgggcgagtcaggccatcagcgattctttagccttggttgcagcaagaaaccagggcgacgcccctanagactcgtagtctagtggtgctatccagattgacgtaagggtcgggtccagtccgaggttcaggtggcagtcgnatcgtagggacagtattaccactctacactatcagcagcctgcacgcctagtaagttnttttgacttaaattttacttacgtagtaactaaactagtttaacttacgtaaccgttaaccccgtagggttacgggtaccggtttcggaccggtaacggggaacctaaggggtacggtaaacgtacccgtaaaccggtacgttggtacgggtctgggtaaccc

SEQ ID NO: 214323 - DNA, 550 bp, Homo sapiens
  misc_feature: GYAE6OF01CH5GH.1.34.D01.1.454.CMB.1.raw
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcgtaaggtgggtcccagtccaggttcaggtggctaggtgcatcgtagggacagattacactctcactatcagcagcctgcacgcctagaacgtnttttcgacttaatttatacgtagtacaactagttattacgttaacgttacccccgttaggtacgggtaccgttaccgggaccggtaaggggaccctaagggtaggtaaacgtaccgaaaccggtacgtaggtcgggactcgaccc

SEQ ID NO: 214324 - DNA, 563 bp, Homo sapiens
  misc_feature: GYAE6OF01CS619.1.34.D01.1.454.CMB.1.raw
  modified_base (282)..(282): a, c, t, g, unknown or other
  misc_feature (282)..(282): n is a, c, g, or t
  modified_base (373)..(373): a, c, t, g, unknown or other
  misc_feature (373)..(373): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgacgaagggtcgggtaccccatcccgaggttcaggtggcagtgcatcgtagggacagattacncttctcatatcagcagtcctagcagcctagaagtattttgacttaattttacttacgtgtacaactagttattacgtaccgttaacccctaggtcggtaccggttcgggacccggtaagggggaccctaaaggggtacgggtaaccgtaccgtaaacccggtaaacttgggtacggccgtcggtaacccg

SEQ ID NO: 214325 - DNA, 538 bp, Homo sapiens
  misc_feature: GYAE6OF01DN7JF.1.34.D01.1.454.CMB.1.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccngggcagcccctnagntcgtagtctatggtgcatccagtattgcgtaaggtcgggtacccagtccgaggttcaggtgctagtgcatcgtgggaacagtaattacgaccttcgtacaacgtatcgaagcacgcctgcagcctagtaagtnttttagacttaaagtttattacgtgtacaactagttatactacgtacccctaggtcggtacgtcggccgtaaggggaccaagggtacgtaagtaccgaaccgtaacgtgtacggtctgtaaccg

SEQ ID NO: 214326 - DNA, 413 bp, Homo sapiens
  misc_feature: GYAE6OF01DB1H9.1.34.D01.1.454.CMB.1.raw
  modified_base (325)..(325): a, c, t, g, unknown or other
  misc_feature (325)..(325): n is a, c, g, or t
  modified_base (400)..(413): a, c, t, g, unknown or other
  misc_feature (400)..(413): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctagaagtattttgactaattttattactgtacaactagtattatacgtaccctagtggacgttcggccaggggaccaaggtgaagtcaaccgatgtgctgcacntctgtcttcactccttcccgctatctgaacgctactcgtctgacggcgggtctgggactaaggccgacaagtcgnnnnnnnnnnnnnn

SEQ ID NO: 214327 - DNA, 726 bp, Homo sapiens
  misc_feature: GYAE6OF01CVQBS.1.34.D01.1.454.CMB.1.raw
  modified_base (224)..(224): a, c, t, g, unknown or other
  misc_feature (224)..(224): n is a, c, g, or t
  modified_base (340)..(340): a, c, t, g, unknown or other
  misc_feature (340)..(340): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatcctccctgtctgcattctatggagacagagtcaccatcacttggccgggngacgtcaggccatcgaagtcgtactttcgtttacgccgttgggttgaccagaccaaggaaaccggacgggacccgaaacccctgaacggtactcgttagttcctaagttcgggtanctaacttcccgaggtattggaccgtaaggggttccggggtaccctaacggttcccgtaggggtttaccaaggttcgggacctaaggtcggtactacggttccggtaggggaacaagttacttaacctacttacctacctaacttaactccgaacgtcgtaaccgtccgtagaccgtaacgtaccgttaggtaaacgtttgtttttacgaacttttaaagtttttaacttaccgttaagtactaaacgttaagttaatttacgtaccgttaaccccgtagggttaccgtaccgggttacgggacccgtaagggggtaaccctaaagggggttcaaaccggttaccgaaaccgggttacttagggtcggacctcgggtaaccctacgg

SEQ ID NO: 214328 - DNA, 570 bp, Homo sapiens
  misc_feature: GYAE6OF01DXDRN.1.34.D01.1.454.CMB.1.raw
  modified_base (244)..(244): a, c, t, g, unknown or other
  misc_feature (244)..(244): n is a, c, g, or t
tcagacgagtgcgtcacgaccggtgctcgatttagatcgtctgtgttgggtttgggcatggacatgagggtccccgctcagctcctggggctcctgctgctctggctccccaggtaccagctgtgacatccaattgacccagtctccatcctccctgtctgcatctattggagacagagtcaccatcacttgccgggcgagtcaggccatcagcgattctttagcctggttgcagcagaaaccngggcgacgcccctcagatcgtagtctagtggtgcatccagtattggacgaagggtcggggtacccagttcccgaggtttcaggtggcaggttgctatcgtagggactaggacttaccacgtctacactatacacgctacgccctggccaacgtcctagaagttatttgaacttaatttacttactgttacaatgttaattaactacgttaaccccgtaggtcggtacgttccggaccgaagggtaccgtaagggtacgaacgtaccgaacgtagtcggtggactacgcacctatcgttcgtacttaccacttcccgtccctacccg

SEQ ID NO: 214329 - DNA, 539 bp, Homo sapiens
  misc_feature: GYAE6OF01ARWRS.1.34.D01.1.454.CMB.1.raw
  modified_base (280)..(280): a, c, t, g, unknown or other
  misc_feature (280)..(280): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcgaagggtggggtccccatccgaggttcaggtcggcagtgcatcgtgggacaggtattacactctcactacncagcacgcctgcagcctgaacgtnttttgactaattttactactgtactaacgtattaattactacgttacccctaggtcggtaccgttcgggcccgtagggggaaccctaaggggtacgaagtacgaaacccggtaacgttgtacgggctggaaccc

SEQ ID NO: 214330 - DNA, 505 bp, Homo sapiens
  misc_feature: GYAE6OF01DDNLR.1.34.D01.1.454.CMB.1.raw
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggccgagcccctcagatcgtagtctatggtgcatccagtattgacgaaggtcgggtccatccaggttcaggtggcagtgcatcgtggacagatacactctacactatcagcagccctgacagcctagtaatatttgacttaatttatactgtacaactagttactttatacgtaccctagtcggtacgttcggacgagggacctagggtcgaaacgtcaacgagtggtgctggcactatcttgtctntactcctcccgac

SEQ ID NO: 214331 - DNA, 526 bp, Homo sapiens
  misc_feature: GYAE6OF01DHV8Q.1.34.D01.1.454.CMB.1.raw
  modified_base (102)..(102): a, c, t, g, unknown or other
  misc_feature (102)..(102): n is a, c, g, or t
  modified_base (282)..(282): a, c, t, g, unknown or other
  misc_feature (282)..(282): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccagggcgacgcccctnagatcgtagtctagtggtgcatccagattgacgaaggtcgggtccccagtccaggttcagtggcagtgcatcgtgggacngattacacttcncactatcagcagcctgcacgcctagaagtatttcgacttaatttattactgtanaactagttattactcgtaaccctggtacgtaccggttcggacggacgggaacgtagggtacggtaacgtaccgaaccggtaatcgggtcgcgtcgacc

SEQ ID NO: 214332 - DNA, 551 bp, Homo sapiens
  misc_feature: GYAE6OF01D02LX.1.34.D01.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattctttagcctggttgcagcagaaccgaggcgacgcccctcagatcgtagtctatggtgcatccagtattgacgaagggtcgggtcccagtccaggttcagtggactagtgcagtctgggacagattacgactctcactatcagcagcctgccagcctgaagttattttgacttaatttacttactagtactaaacgtattaatttacgtaaccgttacccttacggttaggtaccggtttaccgggccggtaaacgggggaccgtaaagggtggtaaacgtaccgaaaccgtacgtggtcgtcgtcgtacc

SEQ ID NO: 214333 - DNA, 531 bp, Homo sapiens
  misc_feature: GYAE6OF01AR10L.1.34.D01.1.454.CMB.1.raw
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccngggcgacgcccctnagatcgtagtctatggtgcatccagnttgcgaagggtcgggtcccagtccaggttcaggtggcagtgcatcgnggacagtacttacactctacactatcagcagcctgcagcctagtaagtntttacgacttaatttattactgtacaacgtagttattacgtacgtacccctaggtcggtacgttcggaccgagggacctagggtagaacgtacgaaccgagtggtcggactcggctaccgtattcgtacgttcttactcttcccgtcccgtacc

SEQ ID NO: 214334 - DNA, 485 bp, Homo sapiens
  misc_feature: GYAE6OF01AICLQ.1.34.D01.1.454.CMB.1.raw
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgatcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagattttgactaatttatactgtacaactagttattatacgtaccctagtcggacgttcggccaggggaccaaggtggaagtcaacgactgnggntgac

SEQ ID NO: 214335 - DNA, 389 bp, Homo sapiens
  misc_feature: GYAE6OF01EO4ZM.1.34.D01.1.454.CMB.1.raw
  modified_base (298)..(298): a, c, t, g, unknown or other
  misc_feature (298)..(298): n is a, c, g, or t
  modified_base (375)..(375): a, c, t, g, unknown or other
  misc_feature (375)..(375): n is a, c, g, or t
  modified_base (381)..(389): a, c, t, g, unknown or other
  misc_feature (381)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcaggctgaagatgtggcagtttattactgtcagcattattatagtattcttcgaccaccttcggccaagggacacgactgganattaaacgaactgtgctgcacatctgtcttcatcctcccgccctctcacgcactcgtctgagcggctggcaagggcncatagnnnnnnnnn

SEQ ID NO: 214336 - DNA, 593 bp, Homo sapiens
  misc_feature: GYAE6OF01AR4QU.1.34.D01.1.454.CMB.1.raw
  modified_base (287)..(287): a, c, t, g, unknown or other
  misc_feature (287)..(287): n is a, c, g, or t
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttcgcagcaaggaaaccgagggcgacgcccctnagatcgtagtctagtggtgcatccagtattgacgaagggtcgggtacccagtccgaggttcaggtggcgagtcgactagtcgtagggacagtacttacgacttctacactancgagcacgcctgcacgctagaacgttnttttacgacttaagttttacttacgtacgtaactaacgttagttaactttaacgtaccgttaacccgttaggttaccggtaaccggttccgggaccggtaaggggaaccgtaagggtaccgggtaaacgtaccgtaaaccgtacgttagggtcggtactcggaaccc

SEQ ID NO: 214337 - DNA, 577 bp, Homo sapiens
  misc_feature: GYAE6OF01DY5GP.1.34.D01.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagatcaccatcacttgccgggcagtcaggccatcagcgattctttagcctggttgcagcaagaaaccgagggcgacgcccctnagatcgtagtctagtggtncatccagtattgcgaagggtcggtacccagtccgaggttcaggtggcagtgactagtcgtgggacagtacttacactctacactatcgagcacgcctagccacgacctagaacgttatttcgacttaatttattactgtacaaacttagttaattaacgtaccgtaccccgttacggttacgggtaccggtttaccgggaccgtaaggggggtaaccctaaggggtacggtaaagtacccgaaaccggtaacgttacggtcggccgttagaacccg

SEQ ID NO: 214338 - DNA, 579 bp, Homo sapiens
  misc_feature: GYAE6OF01DTZ36.1.34.D01.1.454.CMB.1.raw
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtccccatcctccctgtctgcatctattggagacagagtcaccatcacttgccgggcgagtcaggccatcagcgattcttagcctggttgcagcagaaaccaggcgacgcccctcagatcgtagtctatggtgcatccagnttgcgaaggtggggtccatcgaggttcgagtggcagtgctatctgggacagtatacactctacactatcagcagcctgacacgtcctagtaagtattttgacctaagttttaattacgtgttaccaaagttacgttaatttaacgttaccgttaacccccgtaacggttggaccggttacgggcccgtaacgggggtaaacccgtaacgggttaggaaaccggttacgaaaaccccggtaacgttggtacgggtacctcggtcgtaaaccccg

SEQ ID NO: 214339 - DNA, 790 bp, Homo sapiens
  misc_feature: GYAE6OF01EC5Z5.1.34.D01.1.454.CMB.1.raw
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattcgacccagtcctccatccctccctgtctgctattctagttggagacagacgtccaacctatcacgttcggccgggcgacgtcgacggccatcgagcgtatttcgttacgccgttggttcgacacgacgaaacggaaaccggacggggaccgaccggcccctagacggtacgttacgtagttccgtagtcggtacgactacgtccgaagtacgttacgggacgtaacggggttccgggtaccctaacgttcccgtaggttaccgtaaggtcggacgtaggttcgacgtacgtccggtagggaacctagttaacttaccgacgttacctaccgttaactactccgaacgtccaacgtccgtacgactacgtacgtacggtaagtttacgttttacgaacttttaacgttttaaccgttacgttacgttaactaaacgtttaagtttaaccgtttaaccgttaaccccggtttaacccggttaccgggtttaccgggttaacccgggttacccggggtaacccggggtaaacgggggtaaccccggtaaagggggttaaccgggtaaaacccggttaaccggtaaacccgggttaacggttacggggtccggttaaccgtcgtaaaccccgg

SEQ ID NO: 214340 - DNA, 520 bp, Homo sapiens
  misc_feature: GYAE6OF01EPU0Z.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccaggggcgacgcccctnagatcggtagtctatggtgcatccagtattggcaagggtcgggtcccagtccaggttcagtggcagtgcatcgtgggacagattacactctcactatcagcagcctgcagcctagaagtattttgactaatttatactgtaccaagttatattactacgtaccccgttagtggtaccgttcgggccgaagggggaccagggtacgaacggtacaaccggtaacgtgtcggtctgaccg

SEQ ID NO: 214341 - DNA, 563 bp, Homo sapiens
  misc_feature: GYAE6OF01EMCQ7.1.34.D01.1.454.CMB.1.raw
  modified_base (281)..(281): a, c, t, g, unknown or other
  misc_feature (281)..(281): n is a, c, g, or t
  modified_base (386)..(386): a, c, t, g, unknown or other
  misc_feature (386)..(386): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctnagatcgtagtctatggtgcatccagtattgacgaagggtcgggtcccagtccaggttcaggtggcagtgactagtcgtgggaacagtacttacactctacactancagcacgcctgcagcctagaacgttattttgacttaaatttacttactagtactaacgtagttaacttacgtaaccgtaccccttaggtacgggtaccggttccgggaccgtaagggggtaacctaaggggtacgtaacgtaccgtaaaccgtaacgttggtacggtctgtaacccg

SEQ ID NO: 214342 - DNA, 550 bp, Homo sapiens
  misc_feature: GYAE6OF01CQRG5.1.34.D01.1.454.CMB.1.raw
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggttgcagcagaaaccgngggcacgcccctnagatcgtagtctagtggtgcatccagtattgacgtaaggggtcgggtacccagtcccgaggttcaggtggcagtgacatcgtgggacagtattacactctacactatcagcacgcctgacagctagaatntttgacttaatttatactagtactaactagttattacgtaaccgttacccctaggtacggtaccgttcggaccgtaaggggaacctaagggttacggaacgttaccgaaacccggtagttggtcgcgttcgacccg

SEQ ID NO: 214343 - DNA, 682 bp, Homo sapiens
  misc_feature: GYAE6OF01B46CQ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatacctaattcgaccctagtcctccactccctccctgtctgctatctagttggagacagagtccaccatcacgttcggcccgggcgagtcgacggccatcgagcgtatttctttacgccgttggttcgcagaccaaacgaaaaccgaggggccgaccgccccctgaagtactcggtagtctagtggtgctactccaagtattggacgtaaggggtcgggtacccagtcccggtaggttcaggtcggacagtcgactatcggtagggaacagtacttaccacttctactactatcagcacgccgtgccacgtcctagtaacgtttatttcgacttaagttttaacttacgttagtaacctaaacgttaagttaactttaacgttaacccggttaaccccccgttaaggttacgggttaacccggtttacccgggacccgggttaaaggggggtaaacccctaaaggggggttacggtaaaccgttaaacccgaaaacccggttaacgttgggtacggtccgtcggtaacccc

SEQ ID NO: 214344 - DNA, 582 bp, Homo sapiens
  misc_feature: GYAE6OF01CQCWM.1.34.D01.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattggagacagagtcaaccatcacttggccgggngagtcaggccatcagcgtattcttagcctggttgcagcaagaaccagggcgacgcccctcagctcgtagtctatggtgacatccagtattcggacgtaaggtcgggtccagtcccgaggttcgagtggctaggtcgctatcgtaggggacagtacttaccatcctacactatcagcagcctgcagcctagaagttatttacgacttaaatttacttactagtacctaaacgtatttaattacgtaacgttaccccgttaggttaccgggtaacgttccgggaccggtaaagggggtacccgaaagggttacgggaaacgtccgtaaacccgtacgttggtaacggcgtacgtacccg

SEQ ID NO: 214345 - DNA, 535 bp, Homo sapiens
  misc_feature: GYAE6OF01BOT5H.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagatcaccatcacttgccgggcagtcaggccatcagcgtattcttagcctggttcgcagcaagaaaccgngggccacgcccctnagatcgtagtctagtggtgcatccagtacttggacgtaaggggtcgggtacccagtccgtaaggttcgaggtcggcaggtcgctagtcgtacgggaactaggtacttaccgacttctactactatcgagcacgcctgcagctagaagttatttagattaatttactatgtacaatattatactacgtaccctaggtcgtacgttcggacgtaggggacctaaggtgaacgtacgaaccgtagtggcgctgacc

SEQ ID NO: 214346 - DNA, 515 bp, Homo sapiens
  misc_feature: GYAE6OF01DJJ7Z.1.34.D01.1.454.CMB.1.raw
  modified_base (336)..(336): a, c, t, g, unknown or other
  misc_feature (336)..(336): n is a, c, g, or t
  modified_base (489)..(490): a, c, t, g, unknown or other
  misc_feature (489)..(490): n is a, c, g, or t
  modified_base (496)..(496): a, c, t, g, unknown or other
  misc_feature (496)..(496): n is a, c, g, or t
  modified_base (505)..(505): a, c, t, g, unknown or other
  misc_feature (505)..(505): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcaagaaaccagggcgacgcccctcagatcgtagtctatggtgctatctagattgacgtaagggtcggggtcccagtccaggttcaggtgcagtgcagtcgngggacagtacttacactctacactatcagcacgcctgacagccgtagaagtatttgacttaatttacttactgtacaactagtattatacgtaaccctgtacggtacgtcggacgagggacagggtagtaacgtacaaccgtagtggtcgtcnnccactntctgtactnactcctcgcc

SEQ ID NO: 214347 - DNA, 496 bp, Homo sapiens
  misc_feature: GYAE6OF01BORGF.1.34.D01.1.454.CMB.1.raw
  modified_base (393)..(393): a, c, t, g, unknown or other
  misc_feature (393)..(393): n is a, c, g, or t
  modified_base (488)..(488): a, c, t, g, unknown or other
  misc_feature (488)..(488): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgactaatttattactgtacaactagtattatacgtacccctacgtggtaccgttcggccgaggggaccaagggtgaagtcaaccgactagngcgtgacc

SEQ ID NO: 214348 - DNA, 516 bp, Homo sapiens
  misc_feature: GYAE6OF01BYYB1.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcgagtcaggccatcagcgattctttagcctggttgcagcagaaaccagggcgagcccctnagatcgtagtctatggtgcatccagattgctaaggtgggtcccagtccgaggttcaggtggcagtgcatcgtgggacagtattacactctacactatcagcagcctgcagcctagaatattttagacttaatttattactagtacaactagttaattatacgtaccctagtcggtacgttcggccgaggggaccagggtaggaacgtaccgtaaacgacgtaggtcgcgtgacc

SEQ ID NO: 214349 - DNA, 582 bp, Homo sapiens
  misc_feature: GYAE6OF01CRXOI.1.34.D01.1.454.CMB.1.raw
  modified_base (101)..(101): a, c, t, g, unknown or other
  misc_feature (101)..(101): n is a, c, g, or t
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccnctcagctcctggggctcctgctgctctggctcccaggtaccagctgtgacatccaattgacccagtctccatcctccctgtctgcatctatggagacagagtcaccatcacttggccgggnagtcaggccatcagcgtattctttagccttggttgcagcaagaaaccgagggcgacgcccctnagatcgtagtctagtggtgacactccagtagttcgacggtaacggggtcgggtacccagttcccgaggttcgaggtcggcagtgctagtcgtagggacagtacttacactctacactatcagacagcctgcacgtctagaacgttntttagactttaatttattacgtagtactaaatacgttaattacgtaccgttaacccgttacggacgggttaccgttacgggaccggtaaggggtaaccctaaaggggtcgtaaacgtaacctaacccggtaagtcggtacggcgttagacc

SEQ ID NO: 214350 - DNA, 501 bp, Homo sapiens
  misc_feature: GYAE6OF01CES4V.1.34.D01.1.454.CMB.1.raw
  modified_base (281)..(281): a, c, t, g, unknown or other
  misc_feature (281)..(281): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagatcctgtcaggacacagcatggacatgagggtccccgctcagctcctggggctcctgctgctctggctccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctagtggtgcatccagattgcaaggtgggcccatccaggttcagtgcagtgcatcgtagggacagattacactctcatatcagcagcctgcagcctagagtatttgacttaatttatactntacaactagtattatacgtaccctagtggtacgttccggacgacggggaaccaagggtacggaacgtaccgaacgactggtggctacgg

SEQ ID NO: 214351 - DNA, 606 bp, Homo sapiens
  misc_feature: GYAE6OF01CQP5J.1.34.D01.1.454.CMB.1.raw
  modified_base (199)..(199): a, c, t, g, unknown or other
  misc_feature (199)..(199): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (461)..(461): a, c, t, g, unknown or other
  misc_feature (461)..(461): n is a, c, g, or t
  modified_base (600)..(600): a, c, t, g, unknown or other
  misc_feature (600)..(600): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttgganacagatccaaccatcacgttggccgggacgagtcacggccatcgagcgtatttcgtttacgccttgggttnacgagacgaaagaaaccgngggccgacgcccctanagactcggtagtcgtagtggtcactactccaggtattcggacggtaaggggttccgggtaccctagttcccgtagggtttcagggttcggactaggtcgactacgtcggtaggactaggtacttaacncttctacactancagccncgcctgaccngtactaggtaatttatttcgactttaatttcttacgtagtaactaattagttacttactaccgttacccgtaggtacgggtacctacgggaccggagggtaacgtagggtacgaacttccgaaacgtacgttggcgtcncgtacc

SEQ ID NO: 214352 - DNA, 642 bp, Homo sapiens
  misc_feature: GYAE6OF01DGJBF.1.34.D01.1.454.CMB.1.raw
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtctccatcctccctgtctgcatctattggagacagagtcaccatcacttggccgggcagtcaggccatcgagcgtatttctttagccttggttgcagcaagaaaccgngggccgacgcccctnagatcgtagtctagtggtncatccgagtattgacgtagggtcgggtaccagtccgaggttcaggtcggctagtncagtcgtaggacagtattacgactctanaactatcgacgcacgcctgaccgacgtccgttagtaagttacttttacggactttaaatttttacgttacgttacggttaacctaaacgttagtttaacttacgttaaccggttaaccccccgttagggttaccgggtaccgggtttacccgggaaccgggtaacgggggtaacccgtaaagggggttaaccgggaaacgttaacccgtaaaacccgggtaacttgggtaccgggtccgtacgtaaccccg

SEQ ID NO: 214353 - DNA, 671 bp, Homo sapiens
  misc_feature: GYAE6OF01B5090.1.34.D01.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacgttgccgggnagtcaggccatcagcgattcttagcctggttgcagcaagaaccgagggcgacgcccctgagtatcgtagtctagtggngcatccagtattggacgaaggggtcgggtccccagtccgtaggttcaggtggctaggtcgctagttcgaggggactaggtacttaccgacttctacctactactacgagacacgcccgtcggacctacggtaccctaggtaaacgttacgttttttacggaactttaaatttttaacgtttaaccgttggttaacctaaacgttaacgtttaaacttacgttaacccggttaacccccgttaacgggttacgggtaacccggttttacccgggaaccggttaacgggggaaccccggttaaaggggttaccgggtaaaacggttacccgtaaaccggttaacgttcgggtacgggtaccgtcggtaacccg

SEQ ID NO: 214354 - DNA, 569 bp, Homo sapiens
  misc_feature: GYAE6OF01BVZK9.1.34.D01.1.454.CMB.1.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaaggaaaccngggcgacgcccctnagatcgtagtctatggtgcatccagattgcgtaagggtcgggtacccatccgaggttcaggtggcagtcgctagtcgtagggacagtattaccacttctacacttatcagcagcctgcagtcctagaattgtttagacttaaatttacttactcgtaacaacgttagttacttaacgtacgttacccctaggtcggtaccggttccgggaccgtaagggggaccctaaggggtacggtaaacgttacccgtaaaccggtaacgttggtacggccgttcggaacccg

SEQ ID NO: 214355 - DNA, 541 bp, Homo sapiens
  misc_feature: GYAE6OF01D3B4H.1.34.D01.1.454.CMB.1.raw
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcaggccatcagcgtattcttagcctggttgcagcaagaaaccgngggcgacgcccctagagactcgtagtctagtggtgcatccagtattgacgtaagggtcgggtcccagtccgaggttcaggtggctagtgctagtcgtagggacagtattacactctacactatcacgcacgcctgcacgtcctagaatattttgacttaatttactactgtactaactagttattactaacgtacccgtagtacggtaccggttcggaccggtaaggggtaccaagggtagaacgtacgtaaccgagtagcggtctgacc

SEQ ID NO: 214356 - DNA, 525 bp, Homo sapiens
  misc_feature: GYAE6OF01DONIQ.1.34.D01.1.454.CMB.1.raw
  modified_base (279)..(279): a, c, t, g, unknown or other
  misc_feature (279)..(279): n is a, c, g, or t
  modified_base (382)..(382): a, c, t, g, unknown or other
  misc_feature (382)..(382): n is a, c, g, or t
  modified_base (516)..(516): a, c, t, g, unknown or other
  misc_feature (516)..(516): n is a, c, g, or t
tcagacgagtgcgtcacgaccggtgctcgatttagatcgtctgtgttgggtttgggggagtcagaccctgtcaggacacagcatggacatgagggtcccagctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctatggtgcatccagattgcaaggtgggtccatccagttcagtggcagtgcatcgtgggacagattacactctacactagtcagccagcccgnacgacgtctagtaactttgttcaatttaatttacttagtagtactaactattattaacgtaccttaccgtgtacggttacggtccgacgggacggaacggtaaggtaggtaacgtaaccgtaaccgagttcggngtcgtaccg

SEQ ID NO: 214357 - DNA, 793 bp, Homo sapiens
  misc_feature: GYAE6OF01DART7.1.34.D01.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtctccatcctcctgtctgcatctatgganacagatcaccatcacttgccggcagtcagccatcagcgattcttagcctggttgcagcaagaaaccaggcgagcccctcagactcgtagtactagtggtgcataccagtattgcgaaaggtcgggtaccctagtcccgtaaggtttccgaagttacgggacgtaaggtcggtactaacgttacggttacgggggaaacttacgggtaaacttttaaccgaacccgtttaccgttaccctaaaccgtttaaacttaccgaaacggggttaacccaaaccgggtccccctttagggaacccgttaacggtaccccgtttaagggtaaaccggtttaagtttttttacgggaacgtttaaaaacgttttttaactttaaaccgtttaacgggtttaacctaaaaccgttaaaggtttaaactttaacgtttaaacccggtttaaacccccggtttaacggttaccggggttaaccgggttttacccggggaacccggttaaacggggggtaacccggtaaaggggttaaaccgggaaacggttaaaccgtaaacccgggtaaaacgttcgggttaacgggtaccgttcgggtaaaccccg

SEQ ID NO: 214358 - DNA, 573 bp, Homo sapiens
  misc_feature: GYAE6OF01CXOT9.1.34.D01.1.454.CMB.1.raw
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (565)..(565): a, c, t, g, unknown or other
  misc_feature (565)..(565): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatcctccctgtctgcatctattggagacagagtcaccatcacttgccggcagtcaggccatcagcgattctttagcctggttgcagcagaaaccngggcagcccctnagntcgatcatggtncatccagattgacaaggtcgggtcccaagtccgtaggttcaaggtcggctaggtcgacagtcgtaggggaacagtaactttaaccgacttctacgaacttataccagtacaggtccctgaccagacccttagaaacgtactttttagactttaaattttacttaaccgtagttactaactagttaactttacaacggttacccctaggtacggttacgttcgggaccgaaggggtaccaagggttgaaacgttcaaaccggaattggtacgggnttcggacc

SEQ ID NO: 214359 - DNA, 567 bp, Homo sapiens
  misc_feature: GYAE6OF01ANRF4.1.34.D01.1.454.CMB.1.raw
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagtattgacgtaagggtcggggtcccagtccgaggttcaggtcggcagtgcatcgtgggacagtattacnctctcactatcagacacgcctgcacgtcctagaagtnttttacgacttaatttattacgtagtactaaacgtagttaacttacgtacgtaccccgttaggtccggtacgttccgggaccgtaaggggaaccctaaggggtacggaaacggttccgaaaacccggtacgttagggtcggtaccgtgtaacccg

SEQ ID NO: 214360 - DNA, 387 bp, Homo sapiens
  misc_feature: GYAE6OF01A1EFH.1.34.D01.1.454.CMB.1.raw
  modified_base (383)..(387): a, c, t, g, unknown or other
  misc_feature (383)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgagcgggctggcaaggcgcatagnnnnn

SEQ ID NO: 214361 - DNA, 505 bp, Homo sapiens
  misc_feature: GYAE6OF01EKU4M.1.34.D01.1.454.CMB.1.raw
  modified_base (267)..(267): a, c, t, g, unknown or other
  misc_feature (267)..(267): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgagcccctcagatcgtagtctatggtgcatccagattgacgaaggtcgggtccagtccaggttcagtggcagtgcatcgtgggacagattacactctcactatcagcagcctgcagcctgaatatttgactaatttntactgtacaactagtatactacgtaccctagtggaccgttcggaccgtaggggacaagggtacggaagtaccgaaccgtaacgtggtacgctgtacc

SEQ ID NO: 214362 - DNA, 646 bp, Homo sapiens
  misc_feature: GYAE6OF01BYSW0.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgctatctagttggagacagagtcaccatcacgttcggccgggacgagtcacggccatccgagcgtaatttcgtttagccttggttgcagcaacgaaaccgagggcgacgcccctagacgtatcgtaagtctagtggtagctagtcctaagatttcggacgtaaggggtcgggtacctacgtccgaaggttcaggtcgcagtcgactagtcgtagggactagtactactacgtcactactataccgagcctacgccttagaccgtacgtaccgtaagtaaacgtttatttacgtaactttaatttaacgttacgttacgtaacaacgttagtttaacttaacgttaaccgttaacccgttaggttaccgggtaacggtttaccgggacggtaacgggtaccggtaagggtacggtaaacgtaacccgtaaaccgtaggttacggtacggtcgtaggaaccc

SEQ ID NO: 214363 - DNA, 579 bp, Homo sapiens
  misc_feature: GYAE6OF01EFBCA.1.34.D01.1.454.CMB.1.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgtattctttagcctggttgcagcaagaaaccagggccgagcccctnagatcgtagtctatggngcatccagtattgacgaagggtcgggtaccctagtcccgaggttcagtcggcagtgcagtcgngggacagattacactctcacttatcagcagcctgcagcctagaagttattttagactaaattttatactgtactaacgtagttaacttagtaccgttaaccccgtaggttacgggtaacccggttccgggacccggtaagggggtaacccgtaaaggggttacgggaaacgttacccggtaaaaccggtaacgttggtcgggacttcggtaacccg

SEQ ID NO: 214364 - DNA, 561 bp, Homo sapiens
  misc_feature: GYAE6OF01CON8D.1.34.D01.1.454.CMB.1.raw
  modified_base (100)..(100): a, c, t, g, unknown or other
  misc_feature (100)..(100): n is a, c, g, or t
  modified_base (271)..(271): a, c, t, g, unknown or other
  misc_feature (271)..(271): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
  modified_base (443)..(443): a, c, t, g, unknown or other
  misc_feature (443)..(443): n is a, c, g, or t
  modified_base (533)..(533): a, c, t, g, unknown or other
  misc_feature (533)..(533): n is a, c, g, or t
tcagacgagtgcgtcacgaccggtgctcgatttagatcgtctgtgttgggtttggggagtcagaccctgtcaggacacagcatggacatgacggtcccgntcagctctgggctcctgctgctctggctcccaggtaccagctgtgacatccaattcgacccagtctccatccctcctgtcctgcatctatggagacagagtcaccatccagttcgccgggcaagtcaggtccatcgaagcgtattctttagccttggtgcagcaagaaccngggcgaacgcccctagagtactcgtagtcgtaagtggtgacctattaccgagtatttggaccgttaaaggggtcgggtaccccaagttcccgaaggtttcgagtcgganagtgacagtcagggacaggacttanactctacacttncagctagccagcagtcctagaacgtnttttgacttaatttactaccgtatacctaatagttaattacacgtaccctaggtcgtacgttcggccgtaggaccgtaaggtacggtaancgttaaccgacttaggcggtcctggacc

SEQ ID NO: 214365 - DNA, 702 bp, Homo sapiens
  misc_feature: GYAE6OF01EFTH3.1.34.D01.1.454.CMB.1.raw
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagagtcaccatcacttggccgggcgagtcaggccatcagcgtattcttagcctggttncagcaagaaaccgngggcgacgcccctanagactcgtagtctagtggtcgcatccagtattcggacgtaaggggtccgggtacccagtcccgtagggttcaggttcggcaggtcgacagttccgtaggggactaaggtactttaccgacttaccgtactaacttacgtccgaaggcctacggtaccctcggacctacggtacccttagggaaacgttttgtttttacgaacttttaaaagtttttaccttaaccgttaggtaacccttaaacgtaagtttaacttttaaccgttaaccccggttaaccccgttagggttaccgggttaacccggtttccgggaaccgggtaaaccgggggtaacccttaaagggggtaacccggttaaacggtaacccgtaaacccggtaacgttcgggttaacggtccgtaccggtaacccg

SEQ ID NO: 214366 - DNA, 550 bp, Homo sapiens
  misc_feature: GYAE6OF01D7XK9.1.34.D01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagacgagtgcgtcacgaccggtgctcgatttagatcgtctgtgttgggtttggtcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaaccagggcacgcccctnagatcgtagtctatggtgcatccagtattggacgaagggtcgggtacccagtccgaggttcaggtggcagtgctagtcgtagggacagtacttacactctacactatcagcacgcctgcagcctagtaagtatttgacttaatttatactgtacaagtattaattactacgtacccgtagtcggtaccgttcggaccgaggggacctaagggtacggtaacgtacgaaccgtaagtcggtcggtctacggacccacgtacttccgttacgttccttaccacttccgtccccgtac

SEQ ID NO: 214367 - DNA, 569 bp, Homo sapiens
  misc_feature: GYAE6OF01A3DPE.1.34.D01.1.454.CMB.1.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggattcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacgttgccgggcagtcaggccatcagcgtattcttagcctggttgcagcaagaaaccgngggacgacgcccctnagatcgtagtctagtggtncatccgagtattgacgtaagggtcgggtccagtccgtaggttcaggtggcgtagtcgactagtcgtagggacagtacttacacgtctacatactcagcacgcctgacacgtcctagtaagttatttagacttaagttttacttacgtgtaactaacgtagttaattacgtaacgtccccgttaggtcggtaccggttcggaccggtagggaacctaagggtacggaacgtaccgaaaccgtacgtggtacggtcgtgtaacccg

SEQ ID NO: 214368 - DNA, 391 bp, Homo sapiens
  misc_feature: GYAE6OF01D9SYV.1.34.D01.1.454.CMB.1.raw
  modified_base (377)..(377): a, c, t, g, unknown or other
  misc_feature (377)..(377): n is a, c, g, or t
  modified_base (383)..(391): a, c, t, g, unknown or other
  misc_feature (383)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgactgtggctgcaccatctgtcttcatcttcccaccctctcacgcactcgtctgagcgggctggcaaggcncatagnnnnnnnnn

SEQ ID NO: 214369 - DNA, 614 bp, Homo sapiens
  misc_feature: GYAE6OF01BMGKH.1.34.D01.1.454.CMB.1.raw
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaccagggcgagcccctcagatcgtagtctagtggtgcatccagattgcgaagggtcgggtcccagtcccgaggttcaggtggcaggtgcagtcgtagggacagtacttaccactctacactatcagcagcctgcacgcctagtaagttattttagacttaattttaacttactcgttaacctaacgttaagttacttaacgttaaccggttaacccccgttaagggttccgggtaacccggtttacccggggacccggtaacggggggtaacccgttaaagggggttaccggtaaaacgggttacccgaaacccggtaacgttagggtacgggtcccgttcggtaaccccg

SEQ ID NO: 214370 - DNA, 578 bp, Homo sapiens
  misc_feature: GYAE6OF01BL0RL.1.34.D01.1.454.CMB.1.raw
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
  modified_base (456)..(456): a, c, t, g, unknown or other
  misc_feature (456)..(456): n is a, c, g, or t
  modified_base (573)..(573): a, c, t, g, unknown or other
  misc_feature (573)..(573): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtacaccatcacgttcggccgggcgagtcgaggccatcagcgtattcttagcctggtncagcaagaaaccgngggcgacgccccngagtactcggtagtctagtggtnactatccgaagtgttggacgtaaggggtccggtacccagtcccggtaaggttcaggtcggactaggtcgactagtcggtagggaactagtacttacgacttcactactacacgagcacgcctgccgtacgtcctaggaacgtttntttacgaactttaattttacgtactgtaacctaagtagtttactacgtaccgtaccgtaggtcgtaccgtcggaccggtagggaaccgtggtacgaataccgaacgtatggacgtcngtacc

SEQ ID NO: 214371 - DNA, 520 bp, Homo sapiens
  misc_feature: GYAE6OF01DFHUV.1.34.D01.1.454.CMB.1.raw
  modified_base (223)..(223): a, c, t, g, unknown or other
  misc_feature (223)..(223): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcaggccatcagcgattctttagcctggttgcagcagaaaccagggcgagcccctcagatcgtagtctatggtgcatccagattgcgaaggtcgggtcccagtccgaggttcagtggcagtgcatcgtgggacagattacgactctacactatcagcagcctgcagctagaagtntttgacttaatttattactgtacaatattattactacgtaccccgtagtcggtacgttcggaccgaggggacctaagggtacgaagtacctaaaccggtaactggtacggcctgacccg

SEQ ID NO: 214372 - DNA, 386 bp, Homo sapiens
  misc_feature: GYAE6OF01C3DL8.1.34.D01.1.454.CMB.1.raw
  modified_base (373)..(373): a, c, t, g, unknown or other
  misc_feature (373)..(373): n is a, c, g, or t
  modified_base (379)..(386): a, c, t, g, unknown or other
  misc_feature (379)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtaccctacgtggacgttcggccaggggaccaaggtgaagtcaacgactgtggctgcacatctgtctcatcttcccgccctcctcacgcactcgtctgagcggctggcaaggcncatagnnnnnnnn

SEQ ID NO: 214373 - DNA, 587 bp, Homo sapiens
  misc_feature: GYAE6OF01DAEDZ.1.34.D01.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccgttggttcgcagcaagaaaccgagggcgacgcccctnagactcgtagtctagtggtgcataccgagagttcgacgtaaggggtcgggtaccccagttcccgaggtttcaaggtcggctagtgcagtcgtagggacagtattaccaccttctacacttatcgagacacgcctgaccacgccgtagtaagttattttcgaactttaattttacttactagttacaacttagttaattacgttaaccgtaccccgttagtcgggttaccgtccgggaccgaacggggtacgtaagggtcggaaacggtacgaaaccggtaacgtggcggtcgtcgtacc

SEQ ID NO: 214374 - DNA, 529 bp, Homo sapiens
  misc_feature: GYAE6OF01D0A6Z.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattcttagcctggttgcagcagaaaccagggcacgcccctnagatcgtagtctagtggtgcatccagattgacgaagggtggggtaccccatcccaggttcaggtcggcagtcgactatcgtgggacagtattacactctcactatcagtcagcctgcagtcctagaagtattttcgacttaatttattactgtactaagtagtattactacgtaccccttaggtacggtacgttccggaccgaggggaactaagggtagaagtaccaaaccggacttggcggctggaccc

SEQ ID NO: 214375 - DNA, 720 bp, Homo sapiens
  misc_feature: GYAE6OF01BB8AP.1.34.D01.1.454.CMB.1.raw
  modified_base (254)..(254): a, c, t, g, unknown or other
  misc_feature (254)..(254): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcagtcaggccatcagcgtattcttagcctggttncagcagaaaccagggcacgcccctcagactcgtagtctagtggtgctatccagatttggacgaaggggtcgggtacccagtacccgtaggttccaaggttcgggacctaggtcgactaagtcggttagggaactaggtaacttacccgacttccgtacaacttaacgtaccaaggaccaacggtcccttacgggacctaacgggtcccttaagggtaaaacgtttacgtttttaacggaaccttttaaaacgtttttaactttaaccgttacgggtttaaacctaaaccgtttaaagtttaaaccgttttaacgttaacccggtttaaacccccggttaacgggttaccggggttaaacccggttttcccggggaaacccggttaagggggtaaaccccgaaaggggtttaccgaaaacggttaccgtaaaaccggtaacgttcgggaggttaccgtcgtaacccg

SEQ ID NO: 214376 - DNA, 592 bp, Homo sapiens
  misc_feature: GYAE6OF01BOCKB.1.34.D01.1.454.CMB.1.raw
  modified_base (462)..(462): a, c, t, g, unknown or other
  misc_feature (462)..(462): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggcagtcaggccatcagcgtattctttagccttggttcgctagcaagaaaccgagggccgacgcccctagagactcgtagtctagtggtgcatccagtattggacgtaagggtcgggtcccaagtccgtaggttcaggtcggcagtcgactagtcgtagggacagtactacactcgtacactatcgagccacgcctagccagtacctaggtaacgttatttagaacgttaattttactacgtnttacctaaagttagttaacttaagtacccgttacccgtaacggtcggtaccggttacggaccggtaaggggtaaccgtaagggtacggaaacgtaccggtaaaccgtacgtaggtcggcgtcggtaaccc

SEQ ID NO: 214377 - DNA, 565 bp, Homo sapiens
  misc_feature: GYAE6OF01DL216.1.34.D01.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (314)..(314): a, c, t, g, unknown or other
  misc_feature (314)..(314): n is a, c, g, or t
  modified_base (559)..(559): a, c, t, g, unknown or other
  misc_feature (559)..(559): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctatgganacagagtcaccatcacttgccgggngagtcaggccatcagcgtatttctttagcccgttggttcgcagacaagaaaaccgaggggccgaacgcccctcgagactcgtaagtctatggtncatccagtattgacgaaggtcgggtcccatccgaggttcaggtggctagtgactagtcgtagggaactagtacttaccacttcgtacaactatcagcacgccctgccacgctagtaagttattttgaacttaattttacttactacgtactaaacgtagtttattacgtaccgttaaccctaggtcggtacgttcggacgtaggggacctagggtacgagtacccgtaacgaacgtggtacgtcnggtacc

SEQ ID NO: 214378 - DNA, 402 bp, Homo sapiens
  misc_feature: GYAE6OF01BHLRG.1.34.D01.1.454.CMB.1.raw
  modified_base (317)..(317): a, c, t, g, unknown or other
  misc_feature (317)..(317): n is a, c, g, or t
  modified_base (361)..(361): a, c, t, g, unknown or other
  misc_feature (361)..(361): n is a, c, g, or t
  modified_base (390)..(402): a, c, t, g, unknown or other
  misc_feature (390)..(402): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacaacagttattatacgtaccctagtggacgttcgcaggggaccaaggtggaagtcaacgactgtggntgcacatctgtcttcatcttcccgctatctgaacgcactcgtcngacgcgggctgggacaaggcacagtagcnnnnnnnnnnnnn

SEQ ID NO: 214379 - DNA, 822 bp, Homo sapiens
  misc_feature: GYAE6OF01C5HTG.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacactacctaatcgacccagtcctccactcccttcccgtgtctcgctacttcttagttgggaagacaggtacgtaccaacctatcctacgttcgggccggggacgtacgtaccgacggaccatcgagtacgttactttacgtttacggccgtttgggttcgacgacgacgaaacgaaaaccggcggggaccgacccgtccccctagaaggtacgtcggttaacgtacgtagttcgggtcactaacgtaccgaagtacgttacggacggtaaacgggggttccgggtacccctacgtacccggtagggtttccgaaggttcggacgtacggtcgtactacggttcgggtaacgggaactaggttaacttaacctacttacctactaacttacgtacgaacgtacctaccggtccgtacgaccgtaccgtaccgttaagttaaacggttttacgttttacgaacgttttaaacttttttaccgttaacggttaccttaaacctaacgttaacgttttaacgtttaccgttaaaccccgttaaccccggttaacgggttaccgggttacccggttacccgggtaaccgggtaacggggtaaccggttaagggtaaccgggttaaacgtaacccggtaaaccggtaacggttgggttacggaccgttccgaaccccg

SEQ ID NO: 214380 - DNA, 707 bp, Homo sapiens
  misc_feature: GYAE6OF01EA0WW.1.34.D01.1.454.CMB.1.raw
  modified_base (320)..(320): a, c, t, g, unknown or other
  misc_feature (320)..(320): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (696)..(696): a, c, t, g, unknown or other
  misc_feature (696)..(696): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgactactacctaattcgacccagtcctccactccctccctgtctgctatcttagttaggagacgagacgtccacctactcctacgttcgggcccgggacgacgtcgacggccatcgagtacgttacttttcgttacgtccgttggttcgacgacgacgaaacgaaaaccggnggggaccgtaacccgtccccctacggaacgtacgttccggtagttactaggtggtcgactacgtaccgagttacgttcggacggtaaggggtccgggtaccctacgttaccgtaggttcgtagggtcgacgtgtacgactagtcgtaggactagtactacactcactactancanccgtacncctgcctacgtcgtaaggtaatttacgttacgaactttaagtttattacgtagtaaccaagttaatttacttaaccgttacccgttaacccgttacgggtacggttacccgggttccgggaaacccgggtaagggggtaacgtaacggggttaacgtaacgtaaccccggtaaacgtaaccggtgggttaccgntaccggtaacc

SEQ ID NO: 214381 - DNA, 647 bp, Homo sapiens
  misc_feature: GYAE6OF01A14WW.1.34.D01.1.454.CMB.1.raw
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatccctccctgtctgcatctattggagacagagtcaccatcacttgccgggcgagtcaggccatccagcgtatttcttagccttggttcgcagcaaggaaaccgagggcgacgcccctanagactcgtagtctagtggtgactactaccgtaagtagttggacgtaacggggtcgggtaccctacgtccgtaggttcgaggtggctagtgctagtcgtagggacagtacttacgtaccttctactacttacacgtacgaccgagccgtacgcgacgccgttaaggaatttactttcgtaacctttaagttttaacgtaccgttagtacctaaacgttaagttaacttaccgttaaccgtccccgttaagggttacccgggtaacccggtttacgggaacccgggtaaggggaacccgttaaacggggacggttaaaccgtacccgtaaaccggacgttcggtacggcgttcgaaccc

SEQ ID NO: 214382 - DNA, 527 bp, Homo sapiens
  misc_feature: GYAE6OF01AQR2E.1.34.D01.1.454.CMB.1.raw
  modified_base (256)..(256): a, c, t, g, unknown or other
  misc_feature (256)..(256): n is a, c, g, or t
  modified_base (379)..(379): a, c, t, g, unknown or other
  misc_feature (379)..(379): n is a, c, g, or t
  modified_base (511)..(511): a, c, t, g, unknown or other
  misc_feature (511)..(511): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaagggtcgggtcccagtccaggttcaggtgcagtgctagtcgtgggacagtacttacactctcactatcagcacgcctgcagcctagaagtntttgacttaatttattacgtgtacaactagttattactacgtaccctaggtcggtaccgttccggacgtacggggaccaagggtacggaagtccgaaacgtacgtggtcgctgcctactatcgtcgtcttanacttcctcccctaccc

SEQ ID NO: 214383 - DNA, 554 bp, Homo sapiens
  misc_feature: GYAE6OF01B8G6X.1.34.D01.1.454.CMB.1.raw
  modified_base (409)..(409): a, c, t, g, unknown or other
  misc_feature (409)..(409): n is a, c, g, or t
tcagacgagtgcgtcacgaccggtgctcgatttagatcgtctgtgttggggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcagaaaccaggggcagcccctcagatcgtagtctagtggtgcatccagtattcggacgtaaggggtcgggtcccagtccgaggttcaggtggcagtgcagtcgtgggacagacttacactctcactatcagcagctgcagctagaatntttgcttaattattacgtgtactaacgtagttaattacgtaacgtacccgtaggttcggtaacggttccggacggtaacggggaaaccgtaagggtaacggtaaacgtacccgtaaacggacgttaggtagggtcctaggacccg

SEQ ID NO: 214384 - DNA, 531 bp, Homo sapiens
  misc_feature: GYAE6OF01CH10U.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcagcgattctttagcctggttgcagcagaaaccagggcgacgcccctnagatcgtagtctagtggtgcatccagattgcgtaaggtcgggtacccagtccgaggttcaggtcggctaggtcgcagtcgtgggaactagtacttacactctcaactatcagtcacgcctgcacgcctagaacgttattttgacttaatttacttactagtacaactagtattactacgtaccctaggtcgtacgttcggacgagggtaaccagggtacgaacgtacgtaaaccgactggtcgctggacc

SEQ ID NO: 214385 - DNA, 551 bp, Homo sapiens
  misc_feature: GYAE6OF01CJAEO.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgacgcccctnagatcgtagtctatggtgcatccagtattggacaagggtcgggtcccagtccaggttcagtggcagtgcatcgtgggacagattacactctacactatcagcagcctgaccagcctggaaagtattttagacttaatttacttactacgtacaaactagttaattacttaacgttaccccgtacgtcggtacggttaccgggaccgtagggggtaaccgtaagggtacggtaacgtaccgtaaccggtaactggtcggtcgtcggtaccg

SEQ ID NO: 214386 - DNA, 388 bp, Homo sapiens
  misc_feature: GYAE6OF01ESXV1.1.34.D01.1.454.CMB.1.raw
  modified_base (384)..(388): a, c, t, g, unknown or other
  misc_feature (384)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtacaacagtattatagtacccctacgtggacgttcggccaggggaccaaggtggaagtcaaccgaactgtgctgcaccatctgtcttcactctcccgcatctgaacgcactcgtctgagcgggctggcaaggcgcatagnnnnn

SEQ ID NO: 214387 - DNA, 589 bp, Homo sapiens
  misc_feature: GYAE6OF01CNUOA.1.34.D01.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggnagtcaggccatcagcgtattcttagcctggttgcagcaagaaaccgagggcgacgcccctacagactcgtagtctagtggtgcatccagattcggacaagggtcgggtacccagtccgaggttacaggtcggctagtgctagtcgtagggactaggtacttacgacttcctacaactatcacgcacgccgtgccagcctaggtaattattttacgactttaaattttaacttacttcgttaacaactagtttaattacgttaaccgtaccccgtaggttcggtaccggtttaccggggaccgtaagggggaaccctaaggggtacggaaacgtaccgtaaaccggtaacgttggcggtccgtgacccg

SEQ ID NO: 214388 - DNA, 577 bp, Homo sapiens
  misc_feature: GYAE6OF01CDUDN.1.34.D01.1.454.CMB.1.raw
  modified_base (255)..(255): a, c, t, g, unknown or other
  misc_feature (255)..(255): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcacgcccctnagatcgtagtctatggtgcatccagattggcaagggtcgggtcccatccgaggttcagtggcagtncatcngggacagacttacactctcactatcagcagccctgacagcctagaacgtatttgactaatttatactgtacaacagttaacttacacgttaccccgttaaggtcggtaccgttcggaccgaagggggaacctaagggtaggaaacgttacaaaccggtaacgttcggtacggtaccttaggacctaacccgtaagtttcccgtacgggtttaccctttacaaccctttccccgttaccccccggtaccccc

SEQ ID NO: 214389 - DNA, 533 bp, Homo sapiens
  misc_feature: GYAE6OF01DPUBD.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttggggtttgggggagtcagaccctgtcaggacacagcatggacatgagggtccccgctcagcccctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcagcccctnagatcgtagtctagtggtgcatccagtattgacgtaagggtcggggtcccagtccgtaggttcaggtggcaggtgacatcgtagggacagtattacactctacactatcagcagcctgcagcctagaagttattttagacttaattttacttactgtactaactagttaattagtacgtaccctaggtcgacgttcggaccgaagggaccaagggtgaacgtacaaacggtactggtaggtcctgctaccg

SEQ ID NO: 214390 - DNA, 579 bp, Homo sapiens
  misc_feature: GYAE6OF01DUFAU.1.34.D01.1.454.CMB.1.raw
  modified_base (454)..(454): a, c, t, g, unknown or other
  misc_feature (454)..(454): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccgagggcgacgcccctacagatcgtagtctatggtgcatccagtattgacgaaggggtcgggtacccagtcccgtagggttcaggttcggctaggtcgctagtcgtaggggactagtacttaacacttctacacttactcacgcagtccctgcacgtctaggtaattattttcgattaaattttntacttgtacaacgttagtaatttacgtaccgttaacccgtgggttacggaccggtttacgggaccgtaacgggggacctaaggggtacggaacgtaccgaaaccggtaacttggtcgctggaccc

SEQ ID NO: 214391 - DNA, 434 bp, Homo sapiens
  misc_feature: GYAE6OF01BCHON.1.34.D01.1.454.CMB.1.raw
  modified_base (406)..(434): a, c, t, g, unknown or other
  misc_feature (406)..(434): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaattttatactgtacaactagtattataacgtaccctagtggtacgttcggccgaggggaccaaggtggaacgtcaaccgaactgtcgctgcaccatctgtctcactctcccgctatctagaaccgctacgtcgtctagacggtcgggctggacaaggggctactagtagcnnnnnnnnnnnnnnnnnnnnnnnnnnnnn

SEQ ID NO: 214392 - DNA, 387 bp, Homo sapiens
  misc_feature: GYAE6OF01ANE97.1.34.D01.1.454.CMB.1.raw
  modified_base (375)..(375): a, c, t, g, unknown or other
  misc_feature (375)..(375): n is a, c, g, or t
  modified_base (381)..(387): a, c, t, g, unknown or other
  misc_feature (381)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatagtaccctacgtggacgttcggccaggggaccaaggtggaagtcaaccgaactgtggctgcacatctgtctcatctcccgcatctgaacgcactcgtctgagcggctggcaaggcncatagnnnnnnn

SEQ ID NO: 214393 - DNA, 532 bp, Homo sapiens
  misc_feature: GYAE6OF01E0QEI.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctcagatcgtagtctatggtgcatccagattgcgaagggtcgggtcccatccgaggttcagtggcagtgcatcgtagggacagattacacttctcactatcagcagcctgcagtcctagaagtattttcgacttaattttatactgtacaactattaacttatacgttaccctaggtcggtacggttccgacggtaagggaccgtaagggtcggaagtaccaaaccgtaatcggtagctagcctaccaattcgtacgttcttatcttcctcccggtacc

SEQ ID NO: 214394 - DNA, 481 bp, Homo sapiens
  misc_feature: GYAE6OF01C5GK2.1.34.D01.1.454.CMB.1.raw
  modified_base (102)..(102): a, c, t, g, unknown or other
  misc_feature (102)..(102): n is a, c, g, or t
  modified_base (134)..(134): a, c, t, g, unknown or other
  misc_feature (134)..(134): n is a, c, g, or t
  modified_base (191)..(191): a, c, t, g, unknown or other
  misc_feature (191)..(191): n is a, c, g, or t
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (427)..(427): a, c, t, g, unknown or other
  misc_feature (427)..(427): n is a, c, g, or t
  modified_base (448)..(451): a, c, t, g, unknown or other
  misc_feature (448)..(451): n is a, c, g, or t
  modified_base (453)..(481): a, c, t, g, unknown or other
  misc_feature (453)..(481): n is a, c, g, or t
tcagacgagtgcgtcacgaccggtgctcgatttagatcgtctgtggttgggtttgggagtcaggccatcagcgattctttagcctggttgcagcagaaaccngggcagcccctcagatccgtagtctatgggtncatcccagattgcaagggtgggtcccatccaggttcagtggcagtgcatctgggacngtattacactctcaactancaagcagcctgcagcctagaagtnttttgactaattttatactgttaccaatagtaattacgtacgtaccctaggtacggaccgttacgggaccgaggggaacctaagggttcgaacgtaccaaaccgattggtcggctagaccacctagtcctagtccttacgacttccctaccccacccgttcacaaccggtctacgtcgttcaggacggcgggntacgggacacggcaccaatgnnnncnnnnnnnnnnnnnnnnnnnnnnnnnnnnn

SEQ ID NO: 214395 - DNA, 652 bp, Homo sapiens
  misc_feature: GYAE6OF01C37JW.1.34.D01.1.454.CMB.1.raw
  modified_base (100)..(100): a, c, t, g, unknown or other
  misc_feature (100)..(100): n is a, c, g, or t
  modified_base (192)..(192): a, c, t, g, unknown or other
  misc_feature (192)..(192): n is a, c, g, or t
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggttgggggagtcagaccctgtcaggacacagcatggacatgagggtccccntcagctcctgggctcctgctgctctggctcccaggtaccagctgtgacatccaattgacccagtctccatcctcctgtctgcatctatgganacagagtcaccatcacttgcggcagtcagccatcagcgtattcttagccgtggttgccagcaacggaaaccgngggccgtacgcccctgagtatcgtagtctagtggtncatccagtgttgcgtaagggtcgggtcccagtccgtaggttccgaggtcggtacgtagtcgtactacgtcgtagggactaggtaacttaccgtaccttcctacctaacttagtcgaacggtcctaacgtcccgtagtacctacgtacccgttaggtaaacgttacttttacgaactttaaagttttaccgttacgtcgttaaccgtaaacgttaacgtttaacttacgttaacccgtaacccccggtttaggtacgggtaaacccggtttccgggaaccggtaaaggggacccgtaaagggtccggtaaacgacccgtaaacggtaacgttggtcggtccgtcgtaacccg

SEQ ID NO: 214396 - DNA, 689 bp, Homo sapiens
  misc_feature: GYAE6OF01CXT7O.1.34.D01.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtatttctttagccgttggttgcagcaagaaaccgagggcgacgcccctnagactcgtagtctagtggtgcatccgagtattacggacgtaaacggggtcggggtacccctacgttaccgtaggttcgaaggttcgggacgtaggtcgactacgttacggtacgggaactaacggtaactttaaccgacttcctacctaacttataccaagccacgtccctagaccgacgtacctaaggtaaacgtttacgttttcgtaacgtttaaattttaacgttacgtttaacggtaacctaaacgttagtttaaactttacgttaacccgttaaccccggttaacggttccgggttacccggttaccgggtaccggtaaccgggggtaacgtaacggggtacgggtaaacgttaccgtaaaacccggtagttacgggtacggccgttcgtaacccg

SEQ ID NO: 214397 - DNA, 595 bp, Homo sapiens
  misc_feature: GYAE6OF01D4DWS.1.34.D01.1.454.CMB.1.raw
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacgttgccgggcagtcaggccatcgagcgtattcttagcctggttgcagcacgaaaccagggccgacgcccctanagatcgtagtctagtgggtncatccagattgacgaagggtcgggtacccagtccgtaggtcacgtggcagtgacagtcgtaggactagtactaccacgtctaacctagtactacacgacctaacgtcctggacctacggtccgttaagaacgttattttacggaattacgttttatacgtacgtaacaacttaagttactttaacgtaaccgttacccttaggtaccgggtacgttccgggaaccgtagggaaccgtagggtagaaccgtaccaaacggtacgtggtagactcggctacctagtcctagtacttacacttcccgtcccctaccc

SEQ ID NO: 214398 - DNA, 661 bp, Homo sapiens
  misc_feature: GYAE6OF01BHXYW.1.34.D01.1.454.CMB.1.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaacnggcgagcccctnagatcgtagtctatggtgcatccagtattggacaaggtcgggtacccagtccgaggttcaggtggcagtggactagtccgtgggactaggtactttacgaccgttactcgtaacttatccaaggccctaaggtcccgttggacctacggtacccgttaggaaacgtttacgttttagacctttaaagttttaacctttacgtaacggttaacctaaacgttaacggtttaactttagtaacccgttaacccccgttacggttacgggtaacccgggttttccgggacccggaacggggggttaaaccctaacggggttaccgggtaaaacgttaccccgtaaaaccgggtaccttagggttaccggtccgttagggtaaacccc

SEQ ID NO: 214399 - DNA, 585 bp, Homo sapiens
  misc_feature: GYAE6OF01CQD1W.1.34.D01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (578)..(578): a, c, t, g, unknown or other
  misc_feature (578)..(578): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggnagtcaggccatcagcgtattcttagcctggttgcagcaagaaaccngggccagcccctnagatcgtagtctagtggtgacatccagtagttgacgtaagggtcgggtacccagtcccgaggttcaggtggcaggtgactagtcgtgggaactagtaacttaccgactcctacactatccaagccacgtcctggaccacgtccgtaggtaaacgttatttttacggactttaaacttttacgttaacgtacggttactaaacttaggtttactttacgtaaccgttacccgtaggtcggtacggttccggacggtagggaaccgtaggtacggaactaccgaacgtacgtggtacgngtcgacc

SEQ ID NO: 214400 - DNA, 522 bp, Homo sapiens
  misc_feature: GYAE6OF01ED9YK.1.34.D01.1.454.CMB.1.raw
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctcagatcgtagtctatggtncatccagattgcgaaggtcgggtcccatccgaggttcagtggcagtgcagtcgtgggacagtattacactctcactatcagcacgcctgcagccctagaagttatttgacttaattttatactgtacaactagttattatacgtacccctagtcggtaccgttcggccgtaggggacctaagggtacggaacgtaccgaaaccgtaacgtggtcgcgtgaccc

SEQ ID NO: 214401 - DNA, 501 bp, Homo sapiens
  misc_feature: GYAE6OF01DILOC.1.34.D01.1.454.CMB.1.raw
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgagcccctcagatcgtagtctagtggtgcatccagattgcaaggtcgggtcccagtccaggttcagtggcagtgcatctgggacagtattacactctcactatcaagcagcctgccagtcctagaagtattttagctaaattttattactgtacaactagtattactacgtaccctagtgacgtcggaccgagggacgaaggtagagtacacgtaatgngcgtgaccg

SEQ ID NO: 214402 - DNA, 576 bp, Homo sapiens
  misc_feature: GYAE6OF01DRW8A.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (440)..(440): a, c, t, g, unknown or other
  misc_feature (440)..(440): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctatgganacagatcacatcacttggccgggnagtcaggccatcagcgtattcttagccttggttgcagcaagaaccgngggcgacgcccctnagtactcgtagtctagtggtgctaatccagtattcgacgtaagggtcgggtccagtcccgagggttcaggtcggactaggtcgacgtagtcgtagggacagtactaacgtactctacactaatcaggtccagcctagccacgtacctaggtaacgttntttacgaattaatttactacgtacgtacaacgttattacttactaccgtaccctaggtccggtacgttaccgggacgtaaggggacctaaggggtcgtaaacgccgtaaaccggtagtggtacgtcgtagtacccg

SEQ ID NO: 214403 - DNA, 616 bp, Homo sapiens
  misc_feature: GYAE6OF01CMM68.1.34.D01.1.454.CMB.1.raw
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcaagaaaccgaggggccgacgccccctcagatcggtagtccatggtncatccagattgacgaaggggtcgggtcccagtcccgtaggttcaggttggctaggtcgctagtccgtaggggactaaggtactttaaccaccgttcactacttaactcagcacgccctggcacgcctagtaagtattttagacttaagttttacttacgtcgttacaaacgttagttaacttacgttaaccgttaacccccgtaggttaccgggtaccggttaccgggaccggtaacgggggtaacctaaaggggttacggaaacgttaccgaaacccggttacggtaggttcgggcttcggaacccg

SEQ ID NO: 214404 - DNA, 649 bp, Homo sapiens
  misc_feature: GYAE6OF01CD75N.1.34.D01.1.454.CMB.1.raw
  modified_base (259)..(259): a, c, t, g, unknown or other
  misc_feature (259)..(259): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaagaaaccgagggcgacgcccctnagactcgtagtctagtggtgcactccagtattgacgtaagggtcgggtcccagtcccgaggttcaggtggcaggtgcgatcgtagggacagtacttacactctacactatcagcacgcctgaccgtacgcctagtaagttagttttagacttaattttattaccgtagtactaaacgtagtttaattaacgtaaccgttaccccgtagggttacgggtacccggtttccggaaccggtaacggggaaccgtaaggggtacggtaaaccgtaaccgaaacccggtaacgttcgggtaccggtaccgtacgaccccggtaaccttaacgtttcccgtttaccgtttccctttaaccccgtcctttcccccgtttccccccgttacccccccg

SEQ ID NO: 214405 - DNA, 619 bp, Homo sapiens
  misc_feature: GYAE6OF01ASV0O.1.34.D01.1.454.CMB.1.raw
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcagaaccagggcacgcccctnagactcgtagtctatggtgcatccagattgcgaagggtcgggtcccagtccgaggttcaggtggcagtgctagtcgtagggactagtattacactctcactatcagacagccctgccagtcctagtaagttacttttcgaacgttaattttacgttacgtagttaccaaaacgttacgtttaactttaacgttaaccgttacccccgttaacgggttcgggtaaccggtttacccggggaccggtaaacggggggtaaccctaaagggggttaaccgggtaaaccggttaccgaaaaacccggttaaccgttagggttacgggtccgtacggtaacccg

SEQ ID NO: 214406 - DNA, 527 bp, Homo sapiens
  misc_feature: GYAE6OF01CQIWG.1.34.D01.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (430)..(430): a, c, t, g, unknown or other
  misc_feature (430)..(430): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcattctatgganacagagtcaccatcacttggccggnagtcaggccatcagcgtattcttagctgtgcagcagaacnggcacgcccctnanactcgtagtctagtggcacatccagtacttggacgtaaggggtcgggtacccagttccgaggttcagtcggcagtgctagtcgtagggacagtactacactctacactatcacgcacgctgctacgctagagttatttgactttaattattcngtacaatagttaatacgtaccgtacccgttggtcggtacgttccggacggaagggtaccagggtacggaactaccgaaccgagttggacgctcgacc

SEQ ID NO: 214407 - DNA, 513 bp, Homo sapiens
  misc_feature: GYAE6OF01DSNPO.1.34.D01.1.454.CMB.1.raw
  modified_base (286)..(286): a, c, t, g, unknown or other
  misc_feature (286)..(286): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgatttctttacgccttggttgcagcaagaaaccagggcgacgcccctnagatcgtagtctagtggtgcatccagattgcgaaggtcgggtcccatccaggttcagtgcagtgcagtcgtgggacagtacttacacttctcacttancaagcacgtcctgcagcctgaaagtnttttgactaattttatactgtacaactagtattactacgtaccctagtcgacgttcggcgaagggaccgtaaggtcgaagtcgaaacgaacgtgcggctgacc

SEQ ID NO: 214408 - DNA, 497 bp, Homo sapiens
  misc_feature: GYAE6OF01BA09E.1.34.D01.1.454.CMB.1.raw
  modified_base (280)..(280): a, c, t, g, unknown or other
  misc_feature (280)..(280): n is a, c, g, or t
  modified_base (491)..(491): a, c, t, g, unknown or other
  misc_feature (491)..(491): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcgaagggtcgggtcccagtccaggttcaggtggcagtgcatcgtgggacagattacactctcactatcagcagcctgcagcctagaagtattttgactaatttatacgtgtacaatagttattatacgttaccctagtgtaccgttcggaccgtagggaccagggtgaacgtcaacgactgngctgac

SEQ ID NO: 214409 - DNA, 473 bp, Homo sapiens
  misc_feature: GYAE6OF01A2QRO.1.34.D01.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (435)..(436): a, c, t, g, unknown or other
  misc_feature (435)..(436): n is a, c, g, or t
  modified_base (438)..(438): a, c, t, g, unknown or other
  misc_feature (438)..(438): n is a, c, g, or t
  modified_base (441)..(473): a, c, t, g, unknown or other
  misc_feature (441)..(473): n is a, c, g, or t
tcagacgagtgcgtcacgaccggtgctcgatttagatcgtctgtgttgggtttgggtaggtcgaggccgatcagcgattctttagtcctggttgcagcagaaaccaggcggagcccctccagatcgtagtctatggtgcatccagattgcaaggtggggtccatccaggttcagtggcagtgcatctgggacngattacactctcactatcagcagcctagcagcctgaagnttttgctaatttntactgtcaacagtattataacgtcccctagtggtaccgtttcggaccaaggggacaaggtacggaagtacctaaccgaactggtcgcgtancgaccattcngtactcatcgtcccnccatctcgaactccgactcgttcnggaacgtcgggctggaccaaaggggccctanaaacgtttaggctacgngnntnacnnnnnnnnnnnnnnnnnnnnnnnnnnnnnnnnn

SEQ ID NO: 214410 - DNA, 574 bp, Homo sapiens
  misc_feature: GYAE6OF01C1WJJ.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgagcccctnagatcgtagtctagtggtgacatccagattgacgaagggttcgggtacccagtacccgaggttcaggtggacgtaggtgctaagtcgtggggaacaggtaatttacgacttctacacttatcagcacgcctgcagcctgaagtattttgacttaattttatactgtactaactagttaattataaccgttaaccccgtacgttacggtaccgtttccgggaccgtaagggggaacctaaggggtaacgggtaaacgttaccgaaaccggttaactgggtacggcttcggtaacc

SEQ ID NO: 214411 - DNA, 655 bp, Homo sapiens
  misc_feature: GYAE6OF01CQPXH.1.34.D01.1.454.CMB.1.raw
  modified_base (101)..(101): a, c, t, g, unknown or other
  misc_feature (101)..(101): n is a, c, g, or t
tcagacgagtgcgtcacgaccggtgctcgatttagatcgtctgtgttgggtttgggggagtcagaccctgtcaggacacagcatggacatgagggtccccntcagctcctgggctcctgctgctctggctcccaggtaccagctgtgacatccaattgacccagtctccatcctccctgtctgcatctattggagacagatcaccatctacgttcgccgggcagtcaggccatcagcgtattcttagccgttggtgacagcaagaaaccgaggcaccgtccctacaagtctacgtagtctagtggtcactactaccgagtagttacgacggtaacggggtccgggtacccctagtcccggtaaggttcgaagggtcgacgtaggtcgacgtagtccggtagggaactagtacttacgacttcctacaacttatcgagtacagtccgtgacgacgtcgtaagtaagttgttttacgaactttaaagttttacttaacgtcgtaactaaacgttagtttaacgttaacgtacccgtttaacccgttgggttaccgtacccggttaacgggaccggttaaaggggaacccttaaggggttaccggtaaaaccttaaccggaaacccgtttaggtcggttacggccttaccggtaaacc

SEQ ID NO: 214412 - DNA, 463 bp, Homo sapiens
  misc_feature: GYAE6OF01C1C02.1.34.D01.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (424)..(463): a, c, t, g, unknown or other
  misc_feature (424)..(463): n is a, c, g, or t
tcagacgagtgcgtcacgaccggtgctcgatttagatcgtctgtgttggggtttgggagtcaggccatcagcgattctttagcctggttgcagcagaaaccagggcgagcccctcagattcggtagtctatggtgcactccagattgcaagggtggggtcccatccaggttcagtggcagtgcatcgtgggacagattacactctcactatcagcagcctgcagcctgaagtattttgactaatttattactgtcaactagtattatacgtaccccctagtcggacgttcggaccgtagggggaccaagggtggaagtcaaacggactgnggctgcacatctgtccttnatccttcccgctatctgaaccgcacttagctaggacgtccgggctagggacaagggtccacctaagtagcatacnnnnnnnnnnnnnnnnnnnnnnnnnnnnnnnnnnnnnnnn

SEQ ID NO: 214413 - DNA, 542 bp, Homo sapiens
  misc_feature: GYAE6OF01C8ZW2.1.34.D01.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattggagacagagtcaccatcacttgccgggngagtcgaggccatcagcgtattctttagccttggttgcagcaagaaaccgagggcgacgcccctacagactcgtagtctagtggtgacatccagtattgacgaaggggttcgggtacccatccgtaggttcaggtggctagtgcagtcgagggacagtacttaccacttctacactatcaagcacgcctgacagcctagtaagttatttgactttaatttagtactagtacaatagttattactaccgtacccttaggcggtacgttcggaccgtaggggacctagggtcgaacgtacgaaccgtagtggcgcgtgacc

SEQ ID NO: 214414 - DNA, 683 bp, Homo sapiens
  misc_feature: GYAE6OF01BJ356.1.34.D01.1.454.CMB.1.raw
  modified_base (293)..(293): a, c, t, g, unknown or other
  misc_feature (293)..(293): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctatggagacagagtcaccatcacgttggccgggcgagtcgaggccatcgagcgtattcttagccttggttgcagacaggaaaccgagggcgacggccccctnagactcgtagtctagtggtcgcatccgagtagttcgcgtaagggtcgggtaccagtccgaggttcaggtgcgagtcgcgtagtcgtagggacaggtacttaccacgttctacctacttagtacgagccaagtcccgtaggaccgtacggtacctaggtaaacgtttacgttttacgtaacttaactttttaacttaccgttacgtaacctaaaccgttaagtttaacgttaaccgttaacccggtacccccgtttaacgggttacccgggtaaccgggtttacccgggacccggttaaacggggggaacccgttaaagggggtaccgggtaaaacgttacccggtaaacccggtaacggtttaggtaccgggtaccgtcggtaaaccccg

SEQ ID NO: 214415 - DNA, 555 bp, Homo sapiens
  misc_feature: GYAE6OF01CKPSC.1.34.D01.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggtncagcagaaaccnggcgagcccctnagatcgtagtctatggtgcatccagattgcaaggtcgggtcccatccaggttcagtgcagtgcatcgtggacagattacactctcatatcagcagcctgcagcctagagtactttgactaatttatactgtacaacgagttattaactacgttaaccccctaaggttcggtaaccgtttcgggaccgaagggggtaacccaagggttacggaacgtccgaaaaccggtaaccgtaggttcgggacttcggcctaacccgtattccgtacgttacctttacgacttcccgttccccggtacc

SEQ ID NO: 214416 - DNA, 387 bp, Homo sapiens
  misc_feature: GYAE6OF01B2ZPR.1.34.D01.1.454.CMB.1.raw
  modified_base (375)..(375): a, c, t, g, unknown or other
  misc_feature (375)..(375): n is a, c, g, or t
  modified_base (380)..(387): a, c, t, g, unknown or other
  misc_feature (380)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaaattttattactgtacaacagtattatacgtaccctagtgacgttcggccaggggaccaaggtgaatcaacgactgtgctgcaccatctgtcttcatctcccgccctctcacgctactcgtctgacgcggctggcaaggcncatgnnnnnnnn

SEQ ID NO: 214417 - DNA, 595 bp, Homo sapiens
  misc_feature: GYAE6OF01APXTF.1.34.D01.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttncagcaagaaccgngggcacgcccctnagatcgtagtctagtggtgcatccagtattgacgtaaggggtcgggtaccccagtccgtaggtttcaggttcggctaggtcgctagtcgtagggactagtacttacaccttctactactactcgagccgacgtcctgacctacgtcctagtaacgttatttcgaacttaattttacttacgttagtaacctaacgttagttaacttacgtaaccgttacccgttacggtcggtaccggttccgggaccggtaagggtaccgtaagggtacggaacgttaccgtaaaccgtacgtggtcggcctacggtaccc

SEQ ID NO: 214418 - DNA, 619 bp, Homo sapiens
  misc_feature: GYAE6OF01A5VN7.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttgccgggcgagtcaggccatcagcgtattctttagcctggttgcagcaagaaaccgagggccgacgccccctcgagactcgtagtctagtggtgcactcctagattggacgtaaggggtcgggtcccagtcccgtaggttcaggttggcgtagtcgctacgtcgtagggaactagtaacttacacttctactactactcacgcacggcctagccacgtccgtagtaagttattttacgaacttaaactttttaattaaccgttacgttaactaacgttagtttaatttacgtaaccggttaaccccgttacgggtacgggtaccggttccgggacccggtaaggggtaaccggtaagggtaacgggtaacgttaaccgaaccgtaacgttggtcggcgttggacc

SEQ ID NO: 214419 - DNA, 699 bp, Homo sapiens
  misc_feature: GYAE6OF01D43E3.1.34.D01.1.454.CMB.1.raw
  modified_base (332)..(332): a, c, t, g, unknown or other
  misc_feature (332)..(332): n is a, c, g, or t
  modified_base (691)..(691): a, c, t, g, unknown or other
  misc_feature (691)..(691): n is a, c, g, or t
tcagacgagtgcgtcacgaccggtgctcgatttagatcgtctgtgttgggtttgggggagtcagaccctgtcaggacacagcatggacatggagggtcccccgctcagctcctggggctcctgctgctctggctcccaggtaccagctgtgacatccaattcgacccagtcctccatccctccctgtctgcattctagttggagacagagtcaccatcacgttcggccgggtcgagtcacggccagtcagcgttatttcgtttacgccgtggttgcagacgaagaaccgagggccgaccgcccctagagtacgttcgtagtcgtagtggtcnctactaccgagtagtcggacggtacggggtccgggtaccctagttaccgtagggttacgagggttcggacgtaggtcgacgttacggtcggtacggggaactaacggttaactttaccgtaccgttacctacgttaaccttacgtaccgacggtaccgtaacgtcccgtacgaccgtaacgtaccgttaaggtaacgtttagttttacgaactttaacttttacgtacgttacgttaactaacgttacgtttaacttacggttaaccccgtaccgttagggtacccgttaccgggttaccggaccgggtaacggggaccgtaaagggtacgaaccgtacgaaccggtagtcggtcgtcncggtaacc

SEQ ID NO: 214420 - DNA, 611 bp, Homo sapiens
  misc_feature: GYAE6OF01ECAV0.1.34.D01.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctatgganacagatcaccatcacttgccggnagtcaggccatcagcgtattcttagccttggttgcagcaagaaaccgagggcgacgcccctgagatcgtagtctagtggtncatccagattgacgtaaggtcggcccagtccgagttcagtgcagtcgcagtcgtaggaactagtaacttaccgacttccgtactaacttactacaaggtccaacgtcccgtagaccgtacggtcccttaaggtaaacgtttagtttttacgaacttttaaatttttacttaacgtagtaaccttaaacgtagtttaacttacgttaacccgttacccggttacggtcggtaaccggtttccggaccggtaagggaaccgtaagggtacggaaacgttaccgaaccgtaagttcggtcgacgtcgtaaccc

SEQ ID NO: 214421 - DNA, 582 bp, Homo sapiens
  misc_feature: GYAE6OF01DVYRF.1.34.D01.1.454.CMB.1.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtatttcttagcctggtgcagcagaaaccgngggcgacgcccctanagatcgtagtctagtggtncatccagtattggacgaaggggtcgggtacccagtccgtaggttcaggtcggctagtgactagtcgtagggactagtacttacactctacatactcacgcacgcctgcacgctagaattatttgacttaattttactacgtagttaacaaacgttagttaagttaactaccgttaccccgttaggttacgggaccgtttaccggaccggtaaggggtaacctaaaggggtacggtaaacgtaccgtaaacccggtagtagggttcggctcggtaaccc

SEQ ID NO: 214422 - DNA, 658 bp, Homo sapiens
  misc_feature: GYAE6OF01D310L.1.34.D01.1.454.CMB.1.raw
  modified_base (372)..(372): a, c, t, g, unknown or other
  misc_feature (372)..(372): n is a, c, g, or t
  modified_base (647)..(647): a, c, t, g, unknown or other
  misc_feature (647)..(647): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttgcagcaagaaaccgagggcgacgcccctgagacgtcgtagtctagtggtgcatccgagtattgcgtaacggggtcgggtccctagtccgtaggttcaggtgcgagtcgctatcgngggacagtacttacactctacgtactatacgacgtacgtacgtcctaggacctacggtacctagtaaacgtttatttttaccggtaactttaaatttttaacgttacgttcggttaaacctaaacgttaagttttaacgtttacgtttaaacccggttaaccccgtttagggttaccgggtaaccggtttaccgggaacccgggtaaggggtaaacccgtaaggggttacggtaaaccggtaccgtaaacccggtacgttagggtacggttccgnggtaacccccg

SEQ ID NO: 214423 - DNA, 564 bp, Homo sapiens
  misc_feature: GYAE6OF01AQFOF.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtggttggggtttggggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcccagcgattctttagcctggttgcagcagaaccaggggcagcccctnagatcgtagtctatggtgcatccagattgcgtaagggtcggggtccccagtcccaggttcaggtgggctaggtgcagtcgtggggacaggtattacactctacactatcagcagcctgcagcctagaagtattttgacttaattttattactgtacaaacgtagttaattagtaacgttacccctaggttcgggtaccgttccgggccgtaggggggaccctaaaggggttacgggaaacgttaccgaaaacccggtacgtggtcgggcctggtacccg

SEQ ID NO: 214424 - DNA, 633 bp, Homo sapiens
  misc_feature: GYAE6OF01C4EEV.1.34.D01.1.454.CMB.1.raw
  modified_base (287)..(287): a, c, t, g, unknown or other
  misc_feature (287)..(287): n is a, c, g, or t
  modified_base (627)..(627): a, c, t, g, unknown or other
  misc_feature (627)..(627): n is a, c, g, or t
tcagacgagtgcgtcacgaccggtgctcgatttagatcgtctgtgttggggtttggggggagtcagaccctgtcaggacacagcatggacatgagggtccccgctcagctccgtgggctcctgctgctctggctcccgaggtaccagctgtagacatccaattcgacccagtctccactccctcctgtctgctatctatggagacagactcaccagtcacgttcggccgggacagtcaggcctagtcgagtcgtatttcttacgctggtcgacagacaagaaaccgngggaccgaccgcccctagaacgtacttacgttagtacttagtttggacgtctaacgtccaaggtacttacggaacggtaaggggttcccgggtacccaacgttcccggtaggtttacacgggttcggactaaggttcgactacgtcggagggactagtacttaccagttcctacacttatcgaagtccgagccgtacacgtacgcttaaggtaatttatttcgaaactttaattttaccgtacttacgaacttaacgtagtttaactacgtaacccggtccgttagtccgggtaacgttcgggacgaacgggtactaggacgtacacgtactacgtgacncgtgcc

SEQ ID NO: 214425 - DNA, 532 bp, Homo sapiens
  misc_feature: GYAE6OF01ARTTE.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttgccgggcgagtcaggccatcggcgattcttagcctggttgcagcagaaaccagggcgacgcccctnagatcgtagtctagtggtgcatccagtattgacgtaagggtcggggtacccagtcccgtaggttcaggtcggctaggtcgactagtcggtagggacagtaacttaccgactctactactatcacgcacgcctgcagcctagtactatttgacttaatttattactgtactaatagttattactacgtaccctagtcgacgttcggacgtacgggacaaggtcggaacgtacgaacgtacgtgtgctgctacc

SEQ ID NO: 214426 - DNA, 537 bp, Homo sapiens
  misc_feature: GYAE6OF01C4LTL.1.34.D01.1.454.CMB.1.raw
  modified_base (280)..(280): a, c, t, g, unknown or other
  misc_feature (280)..(280): n is a, c, g, or t
  modified_base (531)..(531): a, c, t, g, unknown or other
  misc_feature (531)..(531): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccagggcagcccctnagatcgtagtctatggtgcatccagattgacgaagggtcgggtcccatccgaggttcagtggcagtgcatcgtagggactaggtaattacactctacaactatcaagcacgcctgcagcctgaagtatttgacttaaatttattactgtacaaactagttaattactaacgttaccccttaggtcggtaccgttcggaccgtaaggggaccgaaagggtacggaaacgtaccaaacggtaactggtacggntcgacc

SEQ ID NO: 214427 - DNA, 520 bp, Homo sapiens
  misc_feature: GYAE6OF01ENJRQ.1.34.D01.1.454.CMB.1.raw
  modified_base (102)..(102): a, c, t, g, unknown or other
  misc_feature (102)..(102): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (416)..(416): a, c, t, g, unknown or other
  misc_feature (416)..(416): n is a, c, g, or t
  modified_base (515)..(515): a, c, t, g, unknown or other
  misc_feature (515)..(515): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctcctgtctgcatctattggagacagagtcaccatcacttgccgggcagtcaggccatcagcgtattcttagcctggttgcagcaagaaaccngggcgacgcccctnagatcgtagtctagtggtncatccagtattgacgaagggtcgggtaccagtcccgaggttcaggtcggactagtgctagtcgtagggactagtattacactctcactatacagcagcctgcagcctagtaagttntttagacttaatttatactgtacaatagttattactacgtaccctaggtcggtacgttcggacgtagggactagggtacgaacgtacaacgatgtcgcngtacc

SEQ ID NO: 214428 - DNA, 525 bp, Homo sapiens
  misc_feature: GYAE6OF01CSCJA.1.34.D01.1.454.CMB.1.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (413)..(413): a, c, t, g, unknown or other
  misc_feature (413)..(413): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaaccngggcgacgcccctnagntcgtagtctatggtgcatccagtattgacgaaggtcggggtcccagtccgaggttcaggtggcagtgctagtcgtagggacagtacttacacttctacactatcagcacgcctgcagcctagaagtntttgacttaaatttattaactgtacaactagttaacttatacgtaccctggtacggtacgttcggacgagggaacgaagggtacgaagactaaaccggatggtcggctgacc

SEQ ID NO: 214429 - DNA, 493 bp, Homo sapiens
  misc_feature: GYAE6OF01D5N15.1.34.D01.1.454.CMB.1.raw
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatcgtgggacagattacactctcactatcagcagcctgcagcctagagtatttgactaatttattactgtacaactagtaattatacgtacccctagtcggacgttcggcgaggggaccaagggtgaagtacaacgaactgngcgtgacc

SEQ ID NO: 214430 - DNA, 569 bp, Homo sapiens
  misc_feature: GYAE6OF01B95I3.1.34.D01.1.454.CMB.1.raw
  modified_base (283)..(283): a, c, t, g, unknown or other
  misc_feature (283)..(283): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtccccatcctccctgtctgcatctattggagacagagtcaccatcacttgccgggcgagtcaggccatcagcgtattctttagcctggttgcagcagaaaccagggcgacgcccctnagatcgtagtctagtggtgcactccagtattgacgaagggtcggggtcccagtcccgtaagggttcaaggtcggctagtgctatcgtgggacagtattacactctacactactcagcacgcctgccagcctagaagtatttanacttaatttagttactagtacgaactagttaattacgtactaccccgtagtacgggtaccgttcgggaccgtaggggaaccctaagggtacggtaacggtacctaaaccggtacgttacggtggtaccgtcgaccgtaacccg

SEQ ID NO: 214431 - DNA, 503 bp, Homo sapiens
  misc_feature: GYAE6OF01AQHUZ.1.34.D01.1.454.CMB.1.raw
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcagcccctnagatcgtagtctatggtncatccagattgcgaagggtcgggtccccatcccgaggttccaggtcggcaggtgcatcgtgggacagtattacgacttctacactatcagcacgcctgccagcctagaactntttcgactaatttatctagtacaatattattatacgtccctagtcgtacgttcggactaggggactagggagaacgtcaaccggatgtgctgac

SEQ ID NO: 214432 - DNA, 501 bp, Homo sapiens
  misc_feature: GYAE6OF01A6N0D.1.34.D01.1.454.CMB.1.raw
  modified_base (406)..(406): a, c, t, g, unknown or other
  misc_feature (406)..(406): n is a, c, g, or t
  modified_base (496)..(496): a, c, t, g, unknown or other
  misc_feature (496)..(496): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgccccctcagatcgtagtctatggtgcatccagtattgcgaagggtcgggtcccagtccaggttcaggtggcagtgctatcgtgggactagattacactctcactatcagcagcctgcagtcctagaagtnttttgactaatttattactgtacaatagtattatacgtaccctagtcggaccgttcggccgagggacgaggtgaagtacgaacgatgcgntgacc

SEQ ID NO: 214433 - DNA, 723 bp, Homo sapiens
  misc_feature: GYAE6OF01DH6FJ.1.34.D01.1.454.CMB.1.raw
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggcatggacatgagggtccccgctcagctccgtggggctcctgctgctctggctcccaggtaccagctgtgacatccaattcgacccagtctccatccctccctgtctgcatctatggagacagagtcaccatcacttggccgggcagtcaggccatcagcgtattcttagcctggtgcagcaagaaccgngggcgacgccctgagatcgtagtctagtggtncatccaagtagttgacgaagggtcgggtaccctagtccgtaggttcgaggttcgctagtgacgtagtcggagggaactagtaacttaccgtactcctacgtaactacgtacgacgtacacgcccgtgaccgtaacggtacccgttaggtaaacgtttacgttttacggtaaacctttaagtttttaacgttacgtttacgtaaacgttaaaccgttaagtttaactttaaccgtaacccgggtttaaccccccgtaaggggtttcccgggttaaaccgggtttcgggaacccgggtaacgggggtaaacccgtaaggggtaaccgggtaaacgtacccggtaaaacccggtacggtcgggttacgggacccttacggccctaacccgttacgttaccgtttcgttaccctttacctaacccggtttccccctcccccggttacccc

SEQ ID NO: 214434 - DNA, 399 bp, Homo sapiens
  misc_feature: GYAE6OF01A7KZW.1.34.D01.1.454.CMB.1.raw
  modified_base (391)..(399): a, c, t, g, unknown or other
  misc_feature (391)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaatttattactgtacaactagtattatacgtacccctagtcggacgttcggccgaggggaccaaggtggaagtcaacgatgtgctgcacatctgtcttcattcctcccgcatctgaacgctactcgtctgacgcgggctggcaacggcgacatagnnnnnnnnn

SEQ ID NO: 214435 - DNA, 626 bp, Homo sapiens
  misc_feature: GYAE6OF01A2B7Z.1.34.D01.1.454.CMB.1.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
  modified_base (442)..(442): a, c, t, g, unknown or other
  misc_feature (442)..(442): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggngagtcaggccatcagcgattctttagcctggttgcagcaagaaaccgagggcgacgcccctnagatcgtagtctagtggtgcatccagtattcgacgtaaggggttcgggtaccccagttcccgagggtttccaggtcgggctaaggttcgactaacgtcgtacggggaactaaggtacttaaccgaccttcccgacttaactacacgacacgccgtaccncgacgaccgtagtaacgttagttttagtactaatttaactttaactacgtactaactaacgttatttaactacgtaacccgttaccgtagggtaccggttacggacccggtaacggggtaacgtaacgggtacggtaacggtaacctaaccggtaacgttacggtacggtcgtcgtacgtaacc

SEQ ID NO: 214436 - DNA, 398 bp, Homo sapiens
  misc_feature: GYAE6OF01CQ0SF.1.34.D01.1.454.CMB.1.raw
  modified_base (363)..(363): a, c, t, g, unknown or other
  misc_feature (363)..(363): n is a, c, g, or t
  modified_base (385)..(385): a, c, t, g, unknown or other
  misc_feature (385)..(385): n is a, c, g, or t
  modified_base (390)..(398): a, c, t, g, unknown or other
  misc_feature (390)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatacgtacccctagtggacgttcggccagggggaccaaggtggaagtcaaccgaactgtggctgcacatctgtcttcatccttcccgctatctgaacgcactcgtntgagcgggctgggcaaggcganatagnnnnnnnnn

SEQ ID NO: 214437 - DNA, 386 bp, Homo sapiens
  misc_feature: GYAE6OF01ARNQT.1.34.D01.1.454.CMB.1.raw
  modified_base (376)..(376): a, c, t, g, unknown or other
  misc_feature (376)..(376): n is a, c, g, or t
  modified_base (381)..(386): a, c, t, g, unknown or other
  misc_feature (381)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaagttactattgtcaacaggccaacagtttccctcgaacgttcggccaagggaccaaggtacgaaaccaaacgactgtaggctgcaccatctgtcttcatctcccgccatctagaacgcactcgtctgacgcggctggcaggcnatagnnnnnn

SEQ ID NO: 214438 - DNA, 390 bp, Homo sapiens
  misc_feature: GYAE6OF01EBWQ8.1.34.D01.1.454.CMB.1.raw
  modified_base (382)..(382): a, c, t, g, unknown or other
  misc_feature (382)..(382): n is a, c, g, or t
  modified_base (387)..(390): a, c, t, g, unknown or other
  misc_feature (387)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtcaacagtattatacgtacccctagtggacgttcggccaggggaccagggtggaagtcaaccgatgtggctgcaccatctgtctcatccttcccgcatctgaacgcactcgtctgagcgggctggacaaggcgnatagnnnn

SEQ ID NO: 214439 - DNA, 615 bp, Homo sapiens
  misc_feature: GYAE6OF01A9YJ2.1.34.D01.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcagaaaccgagggcacgccctanagatcgtagtctatggtncatccgagtntgcgtaagggtcgggtcccagtccgaggttcagtcggcagtgcatcgnggacagacttacactctacactatcagcctacgtcctggacacgtccgtaagtaacggttatttacggacttaatttttactacgtacgtactaactgtttaacttaagtacccgttaaccctaggttacggtacgttaccggaccgtaacggggaccgtaagggtcggaaaacgttccgaaaccggttaacggttcggtaacgggttccacggtaccctaaccgtacgtttacggttaccgtttaccctttaacccgtctttccccgttccccgtaacccg

SEQ ID NO: 214440 - DNA, 645 bp, Homo sapiens
  misc_feature: GYAE6OF01BNARU.1.34.D01.1.454.CMB.1.raw
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacgttgccgggcgagtcaggccatcagcgtattctttagcctggttgcagcaagaaaccgagggcgacgcccctgagtatcgtagtctagtggtncactccgagtattggacgtaaggggtcgggtaccccagtcccgtaggttcgaggtggactaggtgacctagtcgtaggggactagtacttaccacttctacaacttataccaggccacgtcccgtgaccgtacgtccgttaaggtaacgtttactttttacggactttaaagttttacttacgttacgtaactaaacgttagtttaactttacgtaacccggttaaccccgttacgggttcgggtaaccggtttccgggaacccggtaaggggacccgtaaaaggggtacggtaaaccgaccgtaaaccgggtaactagggtcggtcgtcgtaacccg

SEQ ID NO: 214441 - DNA, 525 bp, Homo sapiens
  misc_feature: GYAE6OF01CVAYJ.1.34.D01.1.454.CMB.1.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcaagaaaccgngggcgacgcccctcagactcgtagtctagtggtncatccagattgcgaagggtcgggtccccagtccgagggttcaggtcggcagtgctatcgtgggacagtattacactctcaactatcagcagcctgctacgcctagaagtntttgacttaatttntactgtacaatattattactacgtacccttagtcggtaccgttcggaccgtagggaccgtaagggtcggaactacgaacccgatggtacggctgacc

SEQ ID NO: 214442 - DNA, 601 bp, Homo sapiens
  misc_feature: GYAE6OF01EPILS.1.34.D01.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggcagtcaggccatcagcgtattctttagcctggttgcagcagaaaccagggcgacgcccctnagatcgtagtctatggtgcatccagtattgacgtaagggtcgggtcccagtccgaggttcaggtcggcagtgctagtcgtagggacagtacttaccgacttcctactacttatcgagcacgcctgacacgtcctagtaacgttattttcgaactttaattttaacttacgtacgtaacctaaacgtagttaacttaacttaccgttaccccgttacggtcgggtaccgtttcccgggaccgtaagggggaaccctaaggggtacgggtaaacgttaacccgtaaacccggtaacgtgggtacggtcgtcggtaaccc

SEQ ID NO: 214443 - DNA, 514 bp, Homo sapiens
  misc_feature: GYAE6OF01DT8H3.1.34.D01.1.454.CMB.1.raw
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (476)..(481): a, c, t, g, unknown or other
  misc_feature (476)..(481): n is a, c, g, or t
  modified_base (483)..(499): a, c, t, g, unknown or other
  misc_feature (483)..(499): n is a, c, g, or t
  modified_base (501)..(514): a, c, t, g, unknown or other
  misc_feature (501)..(514): n is a, c, g, or t
tcagacgagtgcgtcacgaccggtgctcgatttagatcgtctgtggttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaattttattaactgtacaaacagttaattatagtaccccctaggtggaaccgtttcggaccgaagggggacccaagggttggaaacgttccaaacccgtaacttggtgggccttagcctaaccagttccgtcggttccttcgaacttccgttcccccgcccttctccaacggcctaacgtccggtctggacgtccggggtctggggacctaaaggggccacgtaattcggnctnagcagnnnnnntnnnnnnnnnnnnnnnnngnnnnnnnnnnnnnn

SEQ ID NO: 214444 - DNA, 600 bp, Homo sapiens
  misc_feature: GYAE6OF01CQIJZ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagactcgtagtctatggtgcatccagattgacgaagggtcgggtccccagttcccgaggtttcaggtcgggcaggtcgcatcgtaggggacctaggtaacttaccacttctaccgacttaacgtcaacgcacgtcctgactacgcctagtaaacgttattttcgacttaaattttacttacgttcgtactaaactagttaacttacgttaaccggttaccccttacggttccgggtacgtttaccgggacccgtaaggggtaacccgtaagggtacggaaacgtacccgtaaacgacgttaggtacggcgtggaaccc

SEQ ID NO: 214445 - DNA, 593 bp, Homo sapiens
  misc_feature: GYAE6OF01CP2OV.1.34.D01.1.454.CMB.1.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaaccatcacttggccgggcgagtcaggccatcagcgtattctttagcctggttgcagcagaaaccngggccacgcccctnagntcgtagtctagtggtgcatccagacttggacgaagggtcgggtaccccagtcccgagggttcaggtggcaggtgcatcgtgggacagtattaccactctacactatcagacncgcctgcacgtcctagtaacgttagttttacgactttaaattttattacttacgttacaaacttaagttaacttacgtaaccgttaccccgtaggtaccgggttaccgttacgggaccggtaagggggaacccgttaaaggggtacggtaaacgtacgtaaacccggacttagggtacggccgtacggtaccg

SEQ ID NO: 214446 - DNA, 555 bp, Homo sapiens
  misc_feature: GYAE6OF01B2OAF.1.34.D01.1.454.CMB.1.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (423)..(423): a, c, t, g, unknown or other
  misc_feature (423)..(423): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcaagaaaccngggcgacgcccctnagatcgtagtctatggtgcatccagattgacgagggtcgggtacccatccgaggttcgaggtggcagtgcagtcgtagggacagtacttacacttctacactatacagtcacgtcctgccacgtccgtagtaacgttnttttagactttaatttaagttacttagttacctaaagtagttaattacgttaccgtaccctaggttcggtacgttcggaccgtaagggactaagggtcggtaaagacctaacggactaggcggtctggtacc

SEQ ID NO: 214447 - DNA, 662 bp, Homo sapiens
  misc_feature: GYAE6OF01B9FWW.1.34.D01.1.454.CMB.1.raw
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (626)..(628): a, c, t, g, unknown or other
  misc_feature (626)..(628): n is a, c, g, or t
  modified_base (630)..(631): a, c, t, g, unknown or other
  misc_feature (630)..(631): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (638)..(641): a, c, t, g, unknown or other
  misc_feature (638)..(641): n is a, c, g, or t
  modified_base (643)..(658): a, c, t, g, unknown or other
  misc_feature (643)..(658): n is a, c, g, or t
  modified_base (660)..(662): a, c, t, g, unknown or other
  misc_feature (660)..(662): n is a, c, g, or t
tcagacgagtgcgtcacgaccggtgctcgatttagatcgtctgtgttgggtttggcagtcaggccatcagcgtatttctttagcctggttgcagcaagaaaccgaggggcgacgcccctcagatcgtagtctagtggtgcatccagtattgacgaagggtcggggtcccatccgtaggttcaggtggcagtgcatcgtgggacagtattacactctacactatcagcacgcctgacagtcctaggtaaagttattttcgaacttaaatttttacttaccgttgtaaccaaacgtaagtttaactttaacgtaccggttaaccccctagggttagggtacccggtttaccgggacccggaacgggggtaaaccctaaggggtacgggtaaacgtacccgaaaaccgtaaggtcggtacgggtacctacgaccctaacctaacgtttccggttacggtttccctttaccgaaccgtttcccccgttcccccgaactaacgtttccggtaaccggaaacccgtccttaaaccccgttcgggtttaccgtacgggaacggggtcccggggtacggttaccgggacggtaaaccggggtcgtacgtaaacgttggacngangntcgcgacnnngnnganangnnnncnnnnnnnnnnnnnnnnannn

SEQ ID NO: 214448 - DNA, 627 bp, Homo sapiens
  misc_feature: GYAE6OF01AZMR4.1.34.D01.1.454.CMB.1.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcaagaaaccgagggcgacgcccctnagtactcgtagtctagtggtnacatccagtattggacgtaaggggtcggtaccctagtccgtaggttcaggtcggcaggtgctagtcgagggactagtacttacactctactaactancgacgcgacgtcctgacctacgtacgtagtaacgtttactttagaactttaatttacttacgtagttaacctaagttacgttaactttaaccgtaaccggttaccccggttaggtaccggggtaccggtttaccgggacccgggttaagggggaacccgtaaaggggtaccggtaaaccgttacccggaaaaccgttacggtcgggtacggtcccgtagtaaccccg

SEQ ID NO: 214449 - DNA, 711 bp, Homo sapiens
  misc_feature: GYAE6OF01EF8SM.1.34.D01.1.454.CMB.1.raw
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcacatcacgttgccgggngagtcaggccatcagcgtatttcttagtcctggttcncagcaagaaaccgnggacgacgcccctgagatcgtagtctagtggtgctactccagtagttcgacgtaagggtcgggtacccagtccgtaggttccagtcggacgagtcgactagtcggagggactaacggtattaaccacgttactactaacttagactaacgcgtaacgtccctggaccctacggtaccgttagtaaaggtttattttaccgtaacttttaaacgtttttacgttaacgttaccggttaactaaacgtaagtttaaacttccgtaaaccgtttaacccggttaaacccccgttacggggttaaccgggtttaacccgggttaccccgggtaaccggggaaaccgggggttaaaacccgggaaacgggggtttaaaccgggtaaacccgttaaacccgggaaacccggttaaacggttccggttaccgggtcgtaaacccgg

SEQ ID NO: 214450 - DNA, 398 bp, Homo sapiens
  misc_feature: GYAE6OF01EOJDQ.1.34.D01.1.454.CMB.1.raw
  modified_base (388)..(398): a, c, t, g, unknown or other
  misc_feature (388)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtcaacagtattatagtacccctagtggacgttcggccaggggaccaaggtggaagtcaaccgactgtgctgcaccatctgtcttcatccttcccgcctatctgaacgcactcgtctgagcgggctggacaaggcgcatagnnnnnnnnnnn

SEQ ID NO: 214451 - DNA, 570 bp, Homo sapiens
  misc_feature: GYAE6OF01CPOJB.1.34.D01.1.454.CMB.1.raw
  modified_base (225)..(225): a, c, t, g, unknown or other
  misc_feature (225)..(225): n is a, c, g, or t
  modified_base (293)..(293): a, c, t, g, unknown or other
  misc_feature (293)..(293): n is a, c, g, or t
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatccctccctgtctgcatctattggagacagagtcaccatccacttgccgggngagtcaggccatcagcgtattctttagccttggttgcagcaacggaaaccgcggggcgacgcccctanacgtatcgtagtctagtggtgcatacagtatcggacgtaacggggtcgggtacccacgtccgtaggttcgaggtggacgagtgcagtcgtagggacagtactacactctacacgtancgagcagcctagcagctagtaagtntttgactttaattattactgtacaattattattacgtaaccgtacccgtggtccggtacggttccgggaccgaaggggtaccgaagggtaccggtaacgtaacccgtaaccggaattgggtacgtcgccgtaccg

SEQ ID NO: 214452 - DNA, 530 bp, Homo sapiens
  misc_feature: GYAE6OF01D0KFV.1.34.D01.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcagaaaccagggcgagcccctnagatcgtagtctatggtgcatccagattgcaaggtgggtcccagtccaggttcagtggcagtgcatctgggacagatttacactctcactatcagcagcctgcagcctgaatattttgactaatttattactgtacaacgtagtattactacgttaacccctagtcggtaaccgtttcgggaccgtagggggacctaaaggggtcggaaagttaccgaaaccggtaacgttgggaggtcgtcggacccg

SEQ ID NO: 214453 - DNA, 425 bp, Homo sapiens
  misc_feature: GYAE6OF01AS3ZZ.1.34.D01.1.454.CMB.1.raw
  modified_base (324)..(324): a, c, t, g, unknown or other
  misc_feature (324)..(324): n is a, c, g, or t
  modified_base (402)..(402): a, c, t, g, unknown or other
  misc_feature (402)..(402): n is a, c, g, or t
  modified_base (405)..(425): a, c, t, g, unknown or other
  misc_feature (405)..(425): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctagaagtattttagaaaattttattactgtacaaactagttattatacgtacccctagtggaccgttcggcctaggggacctaaggtggaagtcaaccgatgnggctgcacatctgtcttcactctccccacctcctcacgcactctcgtgacggcgggctcgggacgaaggcgcagtagntcnnnnnnnnnnnnnnnnnnnnn

SEQ ID NO: 214454 - DNA, 679 bp, Homo sapiens
  misc_feature: GYAE6OF01C04FD.1.34.D01.1.454.CMB.1.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattgacccagtcctccatcctccctgtctgcatctattggagacagagtcaccatcacttgccgggnagtcaggccatcagcgtattcttagcctggtgcagcagaaaccngggccgacgcccctnagactcgtagtctatggtncatccagattcgacgtaaggtcgggtacccagtccgaggttcaggtcggctagtgactagtccgtagggactaggacttaccacttacctacgactatcgaagtaccgacgccttacggactacgtacccttaggtaaacgttacgtttttacggaactttaaagtttttaacttaaccgttacgttaacctaaacgttaacgttttaaactttaaccgttaacccggttaaaccccccgttaacgggtaccggggttaacccggtttacccgggaccggtaaaccggggggtaacccgtaaagggggttaccgggtaaaaccggttacccgtaaacccggtaacggttggttaccgggtacgtccggtaaacccg

SEQ ID NO: 214455 - DNA, 567 bp, Homo sapiens
  misc_feature: GYAE6OF01EPH8L.1.34.D01.1.454.CMB.1.raw
  modified_base (197)..(197): a, c, t, g, unknown or other
  misc_feature (197)..(197): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccggcagtcaggccatcagcgattcttagcctggttgcagcagaaaccngggcagcccctnagatcgtatctatggtncatccagattgacaaggtcgggtcccatccgaggttcagtcggcagtgcagtctgggacagtacttacgactcgtacactatcagcagtccctgacagtcctagaagtattttcgacttaatttatacgtgtacctaaacgtagttaattaacttaccgttaccccgttacggttacggtaccggtttaccgggaccgtaacgggggaacccgtaaagggtacgggtaaacgtacccgtaaaccgggtacgttaggtacgggtcctggtaccc

SEQ ID NO: 214456 - DNA, 668 bp, Homo sapiens
  misc_feature: GYAE6OF01DV2OM.1.34.D01.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctcctgtctgcatctatggagacagatcaccatcacttggccggcagtcaggccatcagcgtatttcttagccttggtgcagcaagaaaccnggcgacgccctnagtatcgtagtctagtggtnactactccgagtacttcggacgtaaaggggttccggggtaccctaagttcccgtaagggtttccaaggttcgggactaggttcgacctaagttccggtagggaacctaaggtacttaccactcgtactactactcgagtcacgtccgtagacctacgtccgtagtaaagttacttttacgaacctttaaattttaacgttactacgtaacgtaaacgttaagttaatttaacctaacccggttaccccgttaacggttacggtaccggtttacgggaaccggtaacgggtaacgaagggttaacggaaactaccgaaaccgtaacgttcgggtacgtaccgttcggacctaaccgtgtttaccgttacgttaccttactcctttcgtccgtaccg

SEQ ID NO: 214457 - DNA, 541 bp, Homo sapiens
  misc_feature: GYAE6OF01A7EI1.1.34.D01.1.454.CMB.1.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (536)..(536): a, c, t, g, unknown or other
  misc_feature (536)..(536): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttggccgggcgagtcaggccatcagcgtattcttagcctggttgcagcaagaaaccngggcgacgcccctnagatcgtagtctagtggtgcatccagtattggacgtaaggggtcgggtacccagtccgaaggttcaggtcggctagtgctagtcgagggacagtacttaccactcctacactatacgacgccacgccctaggccacgtccgtagtaagttattttcgaacttaattttacttactgtacaattagttatactacgtaccctaggtcggtacgtcgcgaggggactaaggtgaagtacgaacgtactaggtcgngtgac

SEQ ID NO: 214458 - DNA, 812 bp, Homo sapiens
  misc_feature: GYAE6OF01AW0K5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcgagcgtatttcgttagccgtggttgacagcaacgaaaccgagggccgacgcccctagagtactcgtagtctagtggtcacactaccgagtattcggacggtaaggggtccgggtacccacgtaccgtacggtttcaagggttcggactaggtcgacgtacgttccggtaggggaacctaaggttaaccttaaccgtacccttccgttaaccctaaaccgtttaacttaccggaacgtaccgtaaccggtcccgttacggacccgaacggttacccgttaagggttaaacgtttttacgtttttaccggtaaactttttaaacgttttttaaacgtttaccgttttaacgggttaaacctaaaaccggtttaagtttttaacttttaaaacccggttaaccccggttttaaacccccccggtttaaggggttaacccgggttaaccccggggtttacccggggaaccccggggtaaacgggggtaaaccgggttaacgggggttaacggggtaaacccgtaacccggtaaaacccgggttaacgttacgggggttacgtacccggtacggtaaccccg

SEQ ID NO: 214459 - DNA, 446 bp, Homo sapiens
  misc_feature: GYAE6OF01C17H0.1.34.D01.1.454.CMB.1.raw
  modified_base (378)..(378): a, c, t, g, unknown or other
  misc_feature (378)..(378): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
  modified_base (427)..(446): a, c, t, g, unknown or other
  misc_feature (427)..(446): n is a, c, g, or t
tcagacgagtgcgtcacgaccggtgctcgatttagatcgtctgtgttgggtttgggagtcaggccatcagcgattctttagcctggttgcagcagaaaccagggcgacgcccctcagatcgtagtctatggtgcatccagattgcaagggtgggtcccatccgaggttcagtggcagtgcatcgtgggacagtattacactctacactatcagcagcctgcagcctagaagtattttgactaattttatactgtaccaatagtattactaccgtaccctacggtggtacgttcggaccgacggggaccaagggtgaacgtaccaaccgtactggacgctcgacaccatctgtctctactcctcccgctatctacgacnctacgtcgcggtagccgggntggaccgtaacgggcgacaacgtancgtnnnnnnnnnnnnnnnnnnnn

SEQ ID NO: 214460 - DNA, 530 bp, Homo sapiens
  misc_feature: GYAE6OF01CO148.1.34.D01.1.454.CMB.1.raw
  modified_base (502)..(502): a, c, t, g, unknown or other
  misc_feature (502)..(502): n is a, c, g, or t
  modified_base (504)..(530): a, c, t, g, unknown or other
  misc_feature (504)..(530): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcacgctagaattatttgacttaatttattactgtacaactattaattaactaccgttaccccgtacggtacggtaccggttccgggaccgtaacgggggaacctaagggtacggtaacgtaacccgaaaccggtaacgttgggtacggtacgtcgaccctacctattaccgttgttacctttactactttcccgttccccgacttaactccgtaacgaaccgtactaccgtcgttcgacggacgggtcgggtacgtacgggaaccgacggggtccacgtaagtacgngnnnnnnnnnnnnnnnnnnnnnnnnnnn

SEQ ID NO: 214461 - DNA, 578 bp, Homo sapiens
  misc_feature: GYAE6OF01BDWMO.1.34.D01.1.454.CMB.1.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcagtcaggccatcagcgattctttagcctggttgcagcagaaaccnggggcgacgcccctnagatcgtagtctagtggtgcatccagtattggcgtaagggtcgggtacccagtcccgaggttcagtggcagtgcagtcgagggacagacttacactctacactatcagcagcctgcagcctagaagtatttgactttaatttacttacgtagtacctaaagtagttaacttagtaccgttaccccgttagggtacggtaaccggtttccgggaccggtaacggggtaaaccgtaaggggttacggaaacgtaaccgtaaacccggtaaggttcggtacgggtccgtcggtaaccc

SEQ ID NO: 214462 - DNA, 587 bp, Homo sapiens
  misc_feature: GYAE6OF01DAJIF.1.34.D01.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (413)..(413): a, c, t, g, unknown or other
  misc_feature (413)..(413): n is a, c, g, or t
  modified_base (574)..(574): a, c, t, g, unknown or other
  misc_feature (574)..(574): n is a, c, g, or t
  modified_base (580)..(580): a, c, t, g, unknown or other
  misc_feature (580)..(580): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattcgacccagtctccatccctccctgtctgcatctatgganacagagtcaccatccacttggccgggngagtcaggccatcagcgtattcgttagcctggtgcagcaagaaccgngggcacgcccctnagtatcgtagtctagtggtcgacactccagtagttcggacgtaaggggttccgggtacccagtcccgtaggttcaggtcggactaggtcgactagtcgtagggactagtactacactctacacgtntacgagcaacgcctgaccacggtcctaaggtaacttattttacgaacctttaatttaacgttacgtacgtaactaaactagttaacttacgtaccgttacccgtggtaccgggtagttaccgggacggaagggtactagggtaggaacgtaccgaacgtanggtcgntcggacc

SEQ ID NO: 214463 - DNA, 504 bp, Homo sapiens
  misc_feature: GYAE6OF01EMJFG.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagtattgcaaggtgggtcccatccaggttcaggtggcagtgcatcgtgggacagattacactctcactatcagcacgcctgcagcctagaagtattttgctaattttatactgtacaactagtattatacgtaccccttagtcggacgttcggacgaggggacaagggtacggaagtacgaaccgaactagtcggctgacc

SEQ ID NO: 214464 - DNA, 391 bp, Homo sapiens
  misc_feature: GYAE6OF01BV901.1.34.D01.1.454.CMB.1.raw
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
  modified_base (384)..(391): a, c, t, g, unknown or other
  misc_feature (384)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaattttattactgtcaacagtattatagtacccctagtggacgttcggccaggggaccaaggtggaagtcgaaccgaactgtggctgcaccatctgtctcatctcccgcatctgaacncactcgtctgagcgggctggcaaggcncaatgnnnnnnnn

SEQ ID NO: 214465 - DNA, 700 bp, Homo sapiens
  misc_feature: GYAE6OF01CZQOE.1.34.D01.1.454.CMB.1.raw
  modified_base (286)..(286): a, c, t, g, unknown or other
  misc_feature (286)..(286): n is a, c, g, or t
  modified_base (377)..(377): a, c, t, g, unknown or other
  misc_feature (377)..(377): n is a, c, g, or t
  modified_base (686)..(686): a, c, t, g, unknown or other
  misc_feature (686)..(686): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattgacccagtctccatcctccctgtctgcatctattggagacagatcaaccatcacttggccgggcgagtcaggccatcagcgtattcttagcgtggttgcagacagaaccgagggcgacgcccctnagtatcgtagtctagtggtgactatccgagtagttgacgtaagggttcgggtaccagtcccgtaaggttcgaaggttgggactacgggtanccgtaagtcgtacggggactaacgtacttaacctactacctactaactaatccgaagccgtaacggccttacggcaagggtacccttaggtaaacgtttagttttaaccgaactttaaatttttaacgttaccgtaaggttaaacctaaacgtttaacgttaactttacttaaacccgggttaccccttaaacggggtacggtaccgggtttacccgggaaccgggtaaacggggttaaaccgggaaggtttaacgggggtaaaaccgttaacccggaaaaccgggttaaccgtagggtaccggggttnttcccgtaaacccg

SEQ ID NO: 214466 - DNA, 762 bp, Homo sapiens
  misc_feature: GYAE6OF01DL3L4.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacataccaattcgacccagtcctccactccctccctgtctgcatctatggagacagagtccaccatccacgttcggccgggcgagtcaggccatcgagcgtatttctttacgccgttggtcgcagacgaacggaaaccgaggggccgaccgccccctacgaagtacttacggtacgttacttaggtgggtacgacctaacgtacccgaaggtacgtttcggacggtaaacggggggttcccggggtaacccctaacgttaccccggtaacgggttttccgaagggttcgggaccgtaggttcgacgtacgttcggtacgggaactagtaacttacctaccttcctacaacttactacgacgccacgcccgtagaccgtacgtaccgttaaggtaacgtttagttttacgaactttaaatttttacttaaccgttacgtaacctaaacttaacgtttaacttttaccgttaaccggttaaccccccgttagggtaccgggttaaccgggtttaccggggaacccggtaaacgggggtaacccgtaaaggggttaaccggtaaacggtaacccggtaaaccggtaacgttgggtacggtccgttacgtaacccg

SEQ ID NO: 214467 - DNA, 509 bp, Homo sapiens
  misc_feature: GYAE6OF01CP5JM.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagccccctcagatcgtagtctatggtgcatccagattgcaaggtgggtcccatccaggttcagtggcagtgcatcgtgggacagattacactctcactatcagcagcctgcagcctgaagtnttttgacttaatttattactgtcaactagttattataacgtacccctagtcggtacgttcggccgaggggaccaagggtcggaaagtccgaaaccgtactggtcggctggaccc

SEQ ID NO: 214468 - DNA, 559 bp, Homo sapiens
  misc_feature: GYAE6OF01B9BHW.1.34.D01.1.454.CMB.1.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcacatcacttgccgggngagtcaggccatcagcgtattcttagccttggtgcagcacgaaaccgagggcgacgcccctnagatcgtagtctagtggtcgcatccagtattgacgtaagggtcgggtacccagtccgtaggttcaggtggcagtgcagtcgtagggacagtacttacactctactactatcacgcacgcctgaccagcctaggaattatttcgattaatttacttactgtaactaagtattattaacttaccgtaaccccgtaggtacggtacgttccgggacggacgggtaaccagggtacgaacgtaccaacggtacgtgtcggtactacggcctactatcgttcgttactacgtcttcccgttccacc

SEQ ID NO: 214469 - DNA, 632 bp, Homo sapiens
  misc_feature: GYAE6OF01CTH7L.1.34.D01.1.454.CMB.1.raw
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtcctgcatctattggagacagagtcaccatccacgttcggccgggcgagtcaggccatcagcgattcttagcctggttgcagcaagaaaccngggcacgcccctnagactcgtagtctagtgtgcatccgagtacgtttcggacgtaacgggtcggggtacccacggtccctaagggtttcaacggggttcggaccaaggggttcgacgtaacgtccgggtaggggaacctagtaacgttacctacttcctactaactacgtacacgtcacgcctagccagcctaggaacgttactttagacttaaagtttattacgtacggtacctaatagtttacttaacgttaccgtacccttaggtccgggtacgttacccgggacggtacggggaactaacggggtacgtaacggtaacccgtaaaccggtacgttaggtcggacgtcggtaccc

SEQ ID NO: 214470 - DNA, 582 bp, Homo sapiens
  misc_feature: GYAE6OF01BQPCC.1.34.D01.1.454.CMB.1.raw
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (453)..(453): a, c, t, g, unknown or other
  misc_feature (453)..(453): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctatggagacagagtcaccatcacttggccgggngagtcaggccatcagcgtattcttagcctgtgcagcagaaaccgnggcgacgcccctanaggtactcgtagtctagtggtacgctatccagtattgacgtaagggtcgggtaccagtccgaggttcgaggtcggctaggtcgctaacgtcggtaggacaagttaacttacaccttacgtcaacgttacacgacgtacacgtccgagaccgtaccgtacgagtaaacgttnttttacgacttaacgttttactacgtagtacctaaatacgttattaacgtaccgtaaccgtgtacggtaccgtacggacgtagggaacgtacggtaggaacttaccgaacggtatggacgtctgtaacc

SEQ ID NO: 214471 - DNA, 544 bp, Homo sapiens
  misc_feature: GYAE6OF01CVSAB.1.34.D01.1.454.CMB.1.raw
  modified_base (101)..(101): a, c, t, g, unknown or other
  misc_feature (101)..(101): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (247)..(247): a, c, t, g, unknown or other
  misc_feature (247)..(247): n is a, c, g, or t
  modified_base (272)..(272): a, c, t, g, unknown or other
  misc_feature (272)..(272): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccntcagctcctggggctcctgctgctctggctcccaggtaccagctgtgacatccaattcgacccagtcctccatccctcctgtctgcatctatgganacagatcacatcatgccggnagtcaggcatcagcgtattcttagctggtncagcaagaacgaggcgacgccctanacgatcgtatctagtggcacatccagtatgacgtaagggtcggtccaagttccgaggttcaggtcggacagtgactagtcgtagggacagtacttacactcanactancagcagtccngcagactagtaattnttttacgaactttaatttacgttacctagtacctaaagtgttaacttacgtaacgtaaccccgtaggtacgggtacgttaccggacggtaagggaccaaagggtcgaaacgtaccaaacggtagtgtacggctggaacc

SEQ ID NO: 214472 - DNA, 534 bp, Homo sapiens
  misc_feature: GYAE6OF01B59SS.1.34.D01.1.454.CMB.1.raw
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (421)..(421): a, c, t, g, unknown or other
  misc_feature (421)..(421): n is a, c, g, or t
  modified_base (440)..(440): a, c, t, g, unknown or other
  misc_feature (440)..(440): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctatggagacagatcaccatcacttgccgggngagtcaggccatcgagcgtattctttagcctggttncagcaacgaaaccgagggcgacgcccctnagactcgtagtctagtggncatccagtattgacgtaaggggtcggtacccagtccgaggttcaggtggcaggtcgctagtcgagggacagtaattaccacttctacgactatcagcagcctgccagtcctagaattntttagattaatttatactntaacaatagttactataaccgtacccgtagtcggacgttcgggacgagggaacctaagggtcgaaacgtccgaaacgtagtggactcgtcgacc

SEQ ID NO: 214473 - DNA, 402 bp, Homo sapiens
  misc_feature: GYAE6OF01AJNRP.1.34.D01.1.454.CMB.1.raw
  modified_base (392)..(402): a, c, t, g, unknown or other
  misc_feature (392)..(402): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattaactgtcaacagtattatacgtacccctagtggacgttcggccagggggaccaaggtggaagtcaaccgaactgtggctgcaccatctgtcttcatcttcccgccctcctcacgcactcgtctgagcgggctggcaaggcgcagtagnnnnnnnnnnn

SEQ ID NO: 214474 - DNA, 772 bp, Homo sapiens
  misc_feature: GYAE6OF01DHU2D.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttggggtttgggggagtcagaccctgtcaggacacagcatggacatgaggtccccgntcagctcctggggctcctgctgctctggctcccaggtaccagctgtgacatccaattgacccagtctccatcctccctgtctgctatctagtcggacacagacgtccaacctatcctacgttcgggccgggacgtacggtacgacgggaccctatccggaagtacgttacttttacgtttacggccgtttggggttcacgaacggaccgaaaacggaaaccggcggggtaccgtacccgtaccccccgttaaggaacggtaaccgtttacggttaacgttaccgttaagggttcggacgtactaactacccgaagtacgttcggaacggtaagggggttcccgggtacctacgtaccggttaggttacgaggtcggacgtaggtcgactacgtcggtagggactagtacttaaccgcttctactacttacgtcgaacgtctacgtcctagtaccgacgtaccgttaagtaacgtttctttagaacttttaaagttttacgtacgttacgtaactaacgttacgtttaacttacggtaaccccggttaacccggttagggtaaccgggttacccgttaccggggaaccggtaacgggggtaaccgtaacgggttacgggaaaccgttaacccggtaaaccggtagttagggtaccgtcgtacgtaaccccg

SEQ ID NO: 214475 - DNA, 552 bp, Homo sapiens
  misc_feature: GYAE6OF01DLRLM.1.34.D01.1.454.CMB.1.raw
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcagcgattcttagcctggttgcagcaagaaccgagggcgacgcccctcagatcgtagtctatggtgcatccagtattgacgaagggtcgggtacccagtccgaggttcagtggctagtgctatcgtaggactagtattaccactctcactatcgancacgtcctgcagtcctagtaacttntttagattaattattactagtaacaactagttattaacgtaccgttaacccgtcggtcggaaccggttccggaccggaaacgggtacggtaagggtaacggtaacgtacccgaaacggaacgtggtcgcgtgtaaccg

SEQ ID NO: 214476 - DNA, 614 bp, Homo sapiens
  misc_feature: GYAE6OF01DD32Q.1.34.D01.1.454.CMB.1.raw
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaaccatccacttggccgggngagtcaggccatcagcgatttcttagcctggttgcagcaacgaaacngggcacgcccctcagatcgtagtctagtggtnctactccagtaattcgacgtaacggggttcgggtaccccaagttaccgtaggttaccaggttcggactaggtcgactacgtcggtagggaactagtaacttaccacgttctactaactactcgagtacacgctgacacgctagtaagtacttttacgacttaactttacttactacgtactaaacgtaagtttaacttaccgttacccttcgttacgtaccgttacgttttcgggaacccggtacggggtaacctaaggaccgttagggaacgtaacgtaaacgtaaacgtaaacgtggtacggtaccg

SEQ ID NO: 214477 - DNA, 566 bp, Homo sapiens
  misc_feature: GYAE6OF01DMC1Y.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcagtcaggccatcagcgattcttagcctggttgcagcaacgaaaccgaggggccgacgccccctcgagatcgtagtctatggtgcatccagtattgcgaagggtcgggtccccagtccgaggttcaggtggcagtgctatcgtagggaacaggtacttacacttctacactatcagtcagcctgccagccgttagaagtcttttgacttaatttatactgtaccaactagttaattacgtaaccgtaccccgttagtcggtaccgttccgggacccgaagggggtacctaaaggggtacgggtaaacgtaccgtaaaccggtaacgtgggtacggctcgtaacccg

SEQ ID NO: 214478 - DNA, 559 bp, Homo sapiens
  misc_feature: GYAE6OF01EE849.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctacatcctccctgtctgcatctattggagacagagtcaccatcacttgccgggcgagtcaggccatcagcgattctttagcctggttgcagcagaaaccgagggccgacgcccctcagatcgtagtctatggtgcatccagtagttgcgaagggtcgggtcccagtcccgaggttcaggtggcagtgcagtcgtgggacagtattacactctcactatcagcacgcctgaccagcctagaagtattttgacttaaattttatacgttctactaaactagttaattactaaccgttacccctacggttcgggtaacgttccggggaccgaacgggggtaacccgaagggttacggaacgtaccgtaaccggtaacgtggtacggctggaccc

SEQ ID NO: 214479 - DNA, 644 bp, Homo sapiens
  misc_feature: GYAE6OF01CRCXN.1.34.D01.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacgttgccgggngagtcaggccatcagcgtattcttacgcctggttgcagcaagaaaccgngggccacgcccctanagactacggtagtctagtggtgcactccagtagttggacgtaacggggttcgggtaccccatcccggtaagggttccgaaggttcgggacctagggtcgactaagttccggttaggggacctaggtaactttaaccgtacttacctactactaactccgaacgccacgtccgtagaccacgtccgtaggtaacgttattttacgactttaatttacgttacgttacgtactaacgtaattacgtttaactaccggttacccgtacggttacggtaccggttccgggtaccggtaacggggtaacccgtagggtaacggtaacgtaccgtaacggtaactggtacggcgtcgtacccg

SEQ ID NO: 214480 - DNA, 414 bp, Homo sapiens
  misc_feature: GYAE6OF01D8XJT.1.34.D01.1.454.CMB.1.raw
  modified_base (400)..(414): a, c, t, g, unknown or other
  misc_feature (400)..(414): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacaactagttattaatacgtaccctagtggacgttcggccgaggggaccaaggtggaagtcaaccgaactggtgctgcacatctgtctcatcctcccgcatctgaacgcactcgtctgacgtcgggctgggaccaaggtccgacagtagcnnnnnnnnnnnnnnn

SEQ ID NO: 214481 - DNA, 687 bp, Homo sapiens
  misc_feature: GYAE6OF01A5D5K.1.34.D01.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcgacgcccctnagatcgtagtctagtggtgcatccgagtattgacgtaacggggtcgggtaccccagtcccgtaggttacgagggtcgggactaacggtcgactacggttcggtacggggtaactaagggtactttaaccgaaccttccttaacctaacgttaacttaccgaacggtcccgtaacggtccccttacggaccgaaccggtacccgttaaggtaaacgtttacgttttagtaactttaaatttttaacttacgttacgtaactaaaccgttaagttaactttaacgttaacccggttaaccccgttagggttaccggtaaccgggttaccgggacccggtaacggggaaccggtagggtacgggtaaacgtaccgtaaaccggtacgtggtacggtcgtcggaaccg

SEQ ID NO: 214482 - DNA, 646 bp, Homo sapiens
  misc_feature: GYAE6OF01B4BBG.1.34.D01.1.454.CMB.1.raw
  modified_base (225)..(225): a, c, t, g, unknown or other
  misc_feature (225)..(225): n is a, c, g, or t
  modified_base (376)..(376): a, c, t, g, unknown or other
  misc_feature (376)..(376): n is a, c, g, or t
tcagacgagtgcgtcacgaccggtgctcgatttagatcgtctgtgttgggtttgggggagtcagaccctgtcaggacacagcatggacatggagggtcccccgctcagctcctggggctcctgctgctctggctcccaggtaccagctgtgacatccaattgacccagtctccatcctccctgtctgcatctattggagacagagtcaccatcacttggccgggngagtcaggccatcagtcgtatttcttagccttggttgcagcaagaaaccgagggcgaccgcccctgacgtatccgtagtctagtggtagcatccagtattggacgtaagggtcgggtacccagttcccgaaggttcaggtggcagtcgacngtcgagggaacaggtatacctatacctcgaactactacgagtccacgtcccgtagacctacggtacccttaaggtaacgtttacttttacgaactttaaattttacgtttaactacggttaacccaaagttatttaacgttaacttaacccggttaaccccgttacgggtccggtaccggtttaccggaaccgggtaaggggtaaccgtaagggttaacggaacggtaacccgtaaaccggtaacggttagaccgggtcgtacgtacccg

SEQ ID NO: 214483 - DNA, 533 bp, Homo sapiens
  misc_feature: GYAE6OF01EOVTD.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattggacgaagggtcgggtcccatccgaggttcagtggcagtgctatcgtggacagtactacactctcactatcagcagcctgcagctagaagtatttgacttaatttattactgtacaactagttattatacgtacccttaggtcgtacggttccggaccgtacggggacctaagggtaggaacgtacgaaaccgagtggtcggtctacggccacctagtccttgttccttactacttcccgttcccgac

SEQ ID NO: 214484 - DNA, 665 bp, Homo sapiens
  misc_feature: GYAE6OF01A76D1.1.34.D01.1.454.CMB.1.raw
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccagtcacgttgccgggcgagtcaggccatccgagtcgattcttagccttggttgcagacaacgaaccgagggcgacgtcccctnagacttcgtagtctagtcggtncgtacnccgagtagttggacgtaaggggtcgggtacccctagttcccgtaagggtttcgaacggttgggaccgtaggttcggactagttccggtaggggaacctaacggtaactttaccgaaccttcctactaaccgtttacgaacgtacggaccgtaacgaccccgttggaccaaccggtccgttaaggtaaacgtttattttacccggaattttaacgttttaactaccgtttagaacccttaaagtattacttaacgttaccccgtaccgttacgagggttaaccggtccggccgtaaggggaactagggtacggaaatcccggtaacgaatcggtgccgtgtaaccc

SEQ ID NO: 214485 - DNA, 564 bp, Homo sapiens
  misc_feature: GYAE6OF01B9G2J.1.34.D01.1.454.CMB.1.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggcgagtcaggccatcagcgatttcttagcctggttgcagcaagaaaccgngggcacgcccctanagactcgtagtctagtggtncactcagtattgacgaaggggtcggtcccagtccgtaggttcgaggtcggactaggtgctagtcgtagggactagacttacactctactactatcacgcacgcctagccgagtcctagtaagttntttcgaactttaatttaactcgtacgttacaagttagttacttacgtaaccggttaccctaggtccggtacggttcggaccggtaagggaccgtaagggtacgaacgtaccgaacgacgtggcggcctgtacc

SEQ ID NO: 214486 - DNA, 809 bp, Homo sapiens
  misc_feature: GYAE6OF01DIEK9.1.34.D01.1.454.CMB.1.raw
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatcctccctgtctgcatctagtggagacagagtcaacctatccacgttcggccgggtgacgtcacggccatccgagcgtatttcgtttagccgttggttgcagacaacgaaaccgaggccgacgcccctanagactacgtagtctagtggtgacactccgtaagtattcggacggtaacggggtcgggtaccctacgtacccgtaggttcgaaggtcgggactaaggtcgtactaagttcggtaggggtaaccaagtaactttaacccaccgttacttacctaacttaacgtacaacggacgtaacggcccgtacgtaccgaacgtccgttaaggtaacgtttaacgttttacgtaacttttaaacttttaacgtttaccgtagttaaacctaaacggttaacgttttaaaccgttttaacccggttaaacccggtttaaacccccggtttaacgggttacccgggggtttaaacccgggttacccccgggggaaaacccggggttaaaccgggggggttaaacccggttaaaaacgggggtttaaaccggggtaaaaccgggttaaaccccggtaaaaaccggggtttaaccggtagggggttttaaccgggaccgttacccgggtaaaccccgg

SEQ ID NO: 214487 - DNA, 663 bp, Homo sapiens
  misc_feature: GYAE6OF01D5L8T.1.34.D01.1.454.CMB.1.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (657)..(657): a, c, t, g, unknown or other
  misc_feature (657)..(657): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactccctcctgtctgcatctatgganacagatcacatcacgttggccggcagtcaggccatcgagcgtattcgtttacgcctggttgcacggacaacggaaaccgagggacgaccgccccgtnacgtacgtacgtagttaccgtagttcggtcgtactacgttacccgtaagtacgtttacggacggtaagggggttccgggtaccctaacgtacccggttaaggttacgtaacgggttcgggaccgtaaggtcgtaccgttacgtcgggtacgggaaccgtaggttaacttaaccgtacttccgtactaactacgtacgacgtcgacgtcctagcgtacgtccgtaagtaagttcgtttacgtaactttaagtttacttacgtagtaacctaacgttaattaactacgtaccgttacccgtaggtcggtacgttccggacgtaagggactaagggtacgaacgtaccgacgtactggtcgtcgngtaccg

SEQ ID NO: 214488 - DNA, 425 bp, Homo sapiens
  misc_feature: GYAE6OF01A3LD1.1.34.D01.1.454.CMB.1.raw
  modified_base (226)..(226): a, c, t, g, unknown or other
  misc_feature (226)..(226): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (397)..(425): a, c, t, g, unknown or other
  misc_feature (397)..(425): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagatttacactctcactatcagcagcctgcagcctgaanattttgcaatttatactgtcaacagtattatacgtacccctagtggtacgttcggccgaggggaccaaggtggaagtcaaccgactggtggctgcaccatctgtcttcatcctcccgcctatctgaacgcacgtcgtctgacggcgggctggccaagggcncagtacgngnnnnnnnnnnnnnnnnnnnnnnnnnnnnn

SEQ ID NO: 214489 - DNA, 656 bp, Homo sapiens
  misc_feature: GYAE6OF01BAVDX.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcgagtcaggccatcagcgtattcttagcctggttgcagcaaggaaaccgagggcgacgcccctagagtactcgtagtctagtggtgcatccagtacttgacgtaacgggtcgggtacccagtccgtaaggttcaaggtcggctaggtcgactagtcgtaggggactaaggtacttacgaccttctactacttatcacgcacgtccgtcgacgacgtaccctaggtaaacgtttatttttacgactttaaactttaactttacgttacgttaactaaacgttaagttaactttaacgttaaccgttaccccttagggtaccggttaccggtttaccgggaccggtaaccgggggtaacctaacggggttaccggtaaacggttaacccgaaacccggtaacggtttacgggtaccggtaccgtcggtaaaccccg

SEQ ID NO: 214490 - DNA, 385 bp, Homo sapiens
  misc_feature: GYAE6OF01DSBNQ.1.34.D01.1.454.CMB.1.raw
  modified_base (377)..(385): a, c, t, g, unknown or other
  misc_feature (377)..(385): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaactagtattatagtaccctagtgacgttcggccaggggaccaaggtggaagtcaaccgactgtggctgcaccatctgtctcatctcccgcatcgaacgcactcgtctgagcggctggcaaggcacatagnnnnnnnnn

SEQ ID NO: 214491 - DNA, 645 bp, Homo sapiens
  misc_feature: GYAE6OF01C95NT.1.34.D01.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
tcagacgagtgcgtcacgaccggtgctcgatttagatcgtctgtgttggggtttgggggagtcagaccctgtcgaggacacagcagtggacatggacgggtccccgctcagctccgtggggctcctgctgctctggcctcccaggtaccagctgtgacataccaatcgacccagtcctccatcctccctgtcctgcatctattgganacagatcaccatccacttggccggngacgtacgaggccatcgagacgtattacgtttacgacttaggtttagcgaacgacaacgaaaccgacggggaccgaacggcccctacgacgtacgtcggtaacgtcgtacgtaggtgactacgtaccgtaagtacttacggtacggtaacgggttccggggtaccctaagtaccgtaggttacacggttggcgagtgacgagtcggtaggactagtaactttaaccactactacaacttatacgacgtacgacgactacgacgtacgaccgttagtaacgttattttacgacttaaatttacttaacgagttacctaataagtttacttacgtaaccgttacccgttaggcggtacgtacgggacccgtaaggggacctaaggacgtaacgacgtaaccgtaatgcgctgacc

SEQ ID NO: 214492 - DNA, 571 bp, Homo sapiens
  misc_feature: GYAE6OF01EEYXF.1.34.D01.1.454.CMB.1.raw
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagacaagaaaccgagggcgacgcccctgagatcgtagtctagtggtncatcagtattgactaagggtcggtccatcgaggttcaggtggcaggtgctatcgagggacagtacttacactctactactatcagnacgctagcagtcctagtaacgtatttagacttaattttatactagtactaaacgtagttattacgtacgtacccctaggtacggtaaccggtttccgggaaccggtaaggggtaaccgtaaaggggtacgggtaaacgtaccgtaaaacccggtaacgtagggttcggccgtcgaacccg

SEQ ID NO: 214493 - DNA, 548 bp, Homo sapiens
  misc_feature: GYAE6OF01BA0ZK.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggtgcagcaagaaaccgagggcgacgcccctnagatcgtagtctagtggtgcatccagtattgacgaagggtcgggtcccagtcccgtaggttcaggtcggcagtgcatcgtgggacagtacttacactctacactatcagcagctgcagctagaacgttatttagacttaatttatactcgtaacaacttattaattacgtacgtaccccttaaggtcggtaaccggttccggaccgtaggggaacccaagggtacggaaacgtacgtaaaccggtaacgtaggtcggtctggtacc

SEQ ID NO: 214494 - DNA, 580 bp, Homo sapiens
  misc_feature: GYAE6OF01EL6KX.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcagaaaccgagggcgacgcccctcagatcgtagtctatggtgcatccagattggacaagggtcgggtacccagtccgaggttcaggtcggcagtcgcagtcgtgggacagtacttacactctacactatcagcacgcctgcagcctagtaagtacttttgacttaaagttttaattacgtacgttacgtaaacctagttaacttaacgtaccgttaaccccgttaggtaccgggtaccggttaccgggaccgtaagggggtaacctaaggggtacgtaaacggtacccgtaaaccggtaaactgggtacggcgtgtacccg

SEQ ID NO: 214495 - DNA, 731 bp, Homo sapiens
  misc_feature: GYAE6OF01EEEV9.1.34.D01.1.454.CMB.1.raw
  modified_base (99)..(99): a, c, t, g, unknown or other
  misc_feature (99)..(99): n is a, c, g, or t
tcagacgagtgcgtcacgaccggtgctcgatttagatcgtctgtgttgggtttggggagtcagaccctgtcaggacacagcatggacatgagggtcccntcagctctgggctcctgctgctctggctcccaggtaccagcgtgtcgacactccaattcggaccctagtcctccattcctcctgtctgctatctagttggagacagacgtccacctatccacgtttcggccggggtcgtaagttccgacgggtcctaacgttcgacggtccgtaactttccgtttaacggtccgttgggtttacgccgtaacggtaccaaacggtaaacccggtagggaccgtaacgtccccgtagtaacggtacgttccgtaacgttcgtaagttcgggtactcgtaacgttccgaaggttacgttgaacggtacggtcgggtaccctaggtccgtaggtactacggtgtcgtaggtcgtcgtacgtcgtacgggactaggtacttaccacttcgtacgtacttaacgcgacgtctacgtccgtggtacctacgtcgtaaggttacttacgtttacgaacgtttaacgtttacgtacgtcgttaaccaacggttcgttaacgtacggttaccgttaacccgtaggttaccggtaccggtttaccgggacttaacgggaaccgttagggaccgtaaacggttaccgtaacggtacttacgggacgtccgtacggttaacccg

SEQ ID NO: 214496 - DNA, 398 bp, Homo sapiens
  misc_feature: GYAE6OF01AXSVS.1.34.D01.1.454.CMB.1.raw
  modified_base (389)..(398): a, c, t, g, unknown or other
  misc_feature (389)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccagggggaccaaggtggaagtcaaccgaactgtggctgcaccatctgtcttcatccttcccaccctcctcaccgcactcgtctgagcggctgggcaagggcgcatagnnnnnnnnnn

SEQ ID NO: 214497 - DNA, 691 bp, Homo sapiens
  misc_feature: GYAE6OF01ANW32.1.34.D01.1.454.CMB.1.raw
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcgagcgtatttctttagccttggttgcagacaagaaaccgnggcgacgcccctgagactcgtagtctagtggtcncactccagtacttggacgtaagggtcgggtacccagtccgaggttcaggtcggactaggtcgactagtcggtagggactagtacttaccgacttctactacttacncgagtccgaacggccttagaccgtacggtcccgtaaggtaacgtttacgtttacgaactttaacttttaacgttacgtacggttaaccgttaaacgttaacgtttaacgtttaacgttaacccggttaaccccgtttaaggggttccgggttaaacccgggtttcccggggtaaccggtaaacgggggttaacccggttaaaggggtaaccgggtaaccgttaacccggtaaaacccgggttacgttacgggtcggtaaccgtcggtaaaccccg

SEQ ID NO: 214498 - DNA, 526 bp, Homo sapiens
  misc_feature: GYAE6OF01AWJW5.1.34.D01.1.454.CMB.1.raw
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagacgtcaccatcacttcgccgggcgagtcaggccatcagcgattcttagcctggtgcagcagaaaccngggcgacgcccctcagatcgtagtctatggtgcatccagattggcaagggtcgggtcccagtccaggttcaggtgggcaggtgcatcgtgggacaggtattacactctnactatcagcagcctgcagcctagaagtntttgacttaagtttatactgtacaactgttattactacgtaccctaggtcggtacgttcggacgagggaccagggtgaacgtacaaccggtacgtggtcggntggccaccgtattccgtcgttaccttacacttcccttccccgac

SEQ ID NO: 214499 - DNA, 580 bp, Homo sapiens
  misc_feature: GYAE6OF01ER9NI.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (382)..(382): a, c, t, g, unknown or other
  misc_feature (382)..(382): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccngggcgacgcccctnagatcgtagtctatggtgcatccagtattggctaaggtcgggtaccagtccgaggttccaggtggcaggtgctatcgtagggacagtacttacactctanactatcaagcagcctgacacgcctagtaagttacgtttagacttaaattttactacgttcgtaaactaaacttagttaacttaagtacccgtaacccggttacggtacggtaccggttaccggaccggtaacggggtaccaaagggttacggtaaacgtacccgtaaacgtaacggttggaccggtcgtcgtaacccg

SEQ ID NO: 214500 - DNA, 558 bp, Homo sapiens
  misc_feature: GYAE6OF01EWIR0.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgacgcccctnagatcgtagtctatggtgcatccagattggcaagggtcgggtcccagtccaggttcaggtggcaggtgctagtcgtagggacagtattacactctcactatcagcagcctgcagctagaagtatttgacttaatttatactcgtacaacgtattattacgttacgtaccccgttaggttacgggtaccgttcgggacccggtaaggggaacccgtaaggggttacggaaacgtaccggtaaacccggtaacgtagggtacggtccgtggtaacccg

SEQ ID NO: 214501 - DNA, 591 bp, Homo sapiens
  misc_feature: GYAE6OF01EETLH.1.34.D01.1.454.CMB.1.raw
  modified_base (202)..(202): a, c, t, g, unknown or other
  misc_feature (202)..(202): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagngtcaccatcacttggccgggcgagtcaggccatcagcgattctttagcctggttgcagcaagaacccaggggccacgcccctcagtatcgtagtctaagtggtgacatccaagttcgtaggacgaaggggtcgggtacccatcccgtaggttcaggtggctagtgcagtcgtagggacagtacttacactctactactatacgagcacgcctggcacgctagaagttatttagacttaatttactacgtagtaacaatattaacttacgtaaccgttacccgtaggttacgggaaccgtttccgggaccgtaagggggaaccctaaaggggttaccgggaaacggttacccgaaaccggtaaacgttggtacgggtcctacggtaaccc

SEQ ID NO: 214502 - DNA, 384 bp, Homo sapiens
  misc_feature: GYAE6OF01CEG44.1.34.D01.1.454.CMB.1.raw
  modified_base (255)..(255): a, c, t, g, unknown or other
  misc_feature (255)..(255): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (376)..(384): a, c, t, g, unknown or other
  misc_feature (376)..(384): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtacaaaagtnttatagtaccctagtggacgttcggccaggggaccaaggtgaatcaacgatgtgctgcacatctgtcttcatcttcccgcatctgaacgcactcgtctgagcggntggcaaggcncatagnnnnnnnnn

SEQ ID NO: 214503 - DNA, 395 bp, Homo sapiens
  misc_feature: GYAE6OF01AKPUL.1.34.D01.1.454.CMB.1.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (356)..(395): a, c, t, g, unknown or other
  misc_feature (356)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaatntttnctaattntacntacanatattatctacctgtgcgttcgacgagggaccaagtgacgacaccgtagngtcggctcncacntctntcanctctacactatctcnctctcngtcgcgtcgcgcgcgcacnnnnnnnnnnnnnnnnnnnnnnnnnnnnnnnnnnnnnnnn

SEQ ID NO: 214504 - DNA, 604 bp, Homo sapiens
  misc_feature: GYAE6OF01CRHFC.1.34.D01.1.454.CMB.1.raw
  modified_base (221)..(221): a, c, t, g, unknown or other
  misc_feature (221)..(221): n is a, c, g, or t
  modified_base (306)..(306): a, c, t, g, unknown or other
  misc_feature (306)..(306): n is a, c, g, or t
  modified_base (461)..(461): a, c, t, g, unknown or other
  misc_feature (461)..(461): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctatggagacagagtcacatcacttgccgggnagtcagccatcagcgtattcttagcctggtgcagcaagaaaccgagggcgacgccccctacagaactcgtacgtctagtgggtancatccgagtattcggacgtaaggggtcggggtacccctatacccgaggttacaggtggacaggttgcctaagtcgtacggggactagtaacttaacctactcctacaacttataccgaagccaagcccgtagcctacggtcctaggtaaacgttnttttagaaccttttaaagttaacttacgtatacaatacgttaattactaaccgtacccgtacggtacggtaccgttccggaccggtaaggggaccgtaagggtaggtaacgtaccgaaaccggtattacggcggtcgtcgacc

SEQ ID NO: 214505 - DNA, 591 bp, Homo sapiens
  misc_feature: GYAE6OF01ASY6I.1.34.D01.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaccagggcgacgcccctnagatcgtagtctatggtncatccagattgcgtaagggtcgggtcccagtccgaggttcagtggcagtgcagtcgtgggacagtacttaccacgtctacactatcgagcacgcctgccagtccgtagaattnttttacgacttaaagttttacttacgtgttaccaaactagttaattacgtaaccgttacccctacggttcggtaaccggtttccgggacccggtaacgggggtaacccgtaaaggggttacggtaaacggttaacccgtaaaacccgggtaacgttacggtcgggtccgttaggaacccg

SEQ ID NO: 214506 - DNA, 545 bp, Homo sapiens
  misc_feature: GYAE6OF01CS3DH.1.34.D01.1.454.CMB.1.raw
  modified_base (172)..(172): a, c, t, g, unknown or other
  misc_feature (172)..(172): n is a, c, g, or t
  modified_base (253)..(253): a, c, t, g, unknown or other
  misc_feature (253)..(253): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggtgcagcagaaccagggcgagcccctnagatcgtagtctatggtgcatccagagttgcgaaggtcgggtcccatccgagttcagtggcagtgcatcgtagggacagtacttacactctacactatcagcacgcctgcgagcctagaagttntttagacttaatttntactgtacaatgttattacgtacgttaccctagtggtaccgttcggacgtaggggacctagggtacgaacgtaccgaaaccggtagtggtcgggcttacggaccacgtagttccttacgttaccttacgtaccttcccttaccccctaccccg

SEQ ID NO: 214507 - DNA, 406 bp, Homo sapiens
  misc_feature: GYAE6OF01ASVG9.1.34.D01.1.454.CMB.1.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (382)..(382): a, c, t, g, unknown or other
  misc_feature (382)..(382): n is a, c, g, or t
  modified_base (385)..(406): a, c, t, g, unknown or other
  misc_feature (385)..(406): n is a, c, g, or t
tcagacgagtgcgtcacgaccggtgctcgatttagatcgtctgtgttgggtttgtgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttatactgtcaacagttattatagtacccctagtggacgttcggcaggggaccaaggtgaagtcaacgatgnggctgcacatctgtctcatctccgcatcngacncacgtcgtctgacgcgggctggacgtaagggctcagtagnagnnnnnnnnnnnnnnnnnnnnnn

SEQ ID NO: 214508 - DNA, 521 bp, Homo sapiens
  misc_feature: GYAE6OF01BHSIE.1.34.D01.1.454.CMB.1.raw
  modified_base (300)..(300): a, c, t, g, unknown or other
  misc_feature (300)..(300): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagactcgtagtctatggtncatccagattgacgaagggtcgggtcccatccgaggttcaggtggcagtcgctatcgtagggacagacttacactcacactatcagcagcctgcacgtcctagaacgtntttagactaatttatactgtacaatagttattacgtacgtacccgtagtcggacgttacggccgtaggggaacctagggtagaacgtaccgaacgtacgtgtcggctgaccg

SEQ ID NO: 214509 - DNA, 685 bp, Homo sapiens
  misc_feature: GYAE6OF01ASXXP.1.34.D01.1.454.CMB.1.raw
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgatttcttagcctggttgcagcagaaaccgagggcgacgcccctnagtactcgtagtctagtggngcatccagtattgacgtaagggtcgggtacccagtaccgtaggttcaaggtcggacgtaggtcgacgtacgtcgtacgggaactaaggtacttaaccacttcgtactaactatacgacgcaacgtcctacggacctacggtacccgttaaggtaaacgtttacgttttacgtaactttaaatttttacgttaaccgttagttaacctaaacgttaacgtttaactttaaccggtaaccgttaacccccggttacgggttaccgggtaaccccgggtttaccggggaaccccgggttaaacggggggtaacccgtaaagggggtacggtaaaccggtaacccgaaaccggtacggttagggtacggtccgtacggtaacccg

SEQ ID NO: 214510 - DNA, 526 bp, Homo sapiens
  misc_feature: GYAE6OF01EQGR0.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggccgacgcccctcagatcgtagtctagtggtgcatccagattgcgtaagggtcgggtacccatcccgaggttcaggtggcaggtgcagtcgtgggacagtattacactctcactatcagcacgcctgcagcctagaacgttatttgacttaaatttacttactgtactaactagttatactacgtaccctagtcggtacgttcggaccgtaggggacctaagggtcggaataccgtaacgacttggcggcgtgacc

SEQ ID NO: 214511 - DNA, 636 bp, Homo sapiens
  misc_feature: GYAE6OF01A1AG3.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccgagggcacgcccctnagactcgtagtctagtggtgcactccagtacttgacgtaagggtcgggtcccagtcccgaggtttcaggtcggcgtagttcgactcgttggacgtagacttactactacttcactatcacgacacgtccgtcgacgtacgtacctaggtaacgtaacttttacgtacgttaaattttactttaacttagtacgtaactaacgttactttaacgtaacgttaccccgtacggttacggtaccggttacgggtaccccggtaaggggtaacccggttaaaggggtaaccgggtaaacggttacccgaaacccggtaaacccggttaggttacgggcgttaccggtacgtaaccccg

SEQ ID NO: 214512 - DNA, 708 bp, Homo sapiens
  misc_feature: GYAE6OF01D7BQU.1.34.D01.1.454.CMB.1.raw
  modified_base (105)..(105): a, c, t, g, unknown or other
  misc_feature (105)..(105): n is a, c, g, or t
  modified_base (236)..(236): a, c, t, g, unknown or other
  misc_feature (236)..(236): n is a, c, g, or t
tcagacgagtgcgtcacgaccggtgctcgatttagatcgtctgtgttgggtttgggggagtccagaccctggtcacggacacagtcatggacatgaggtccccgntcagctcctggggctcctgctgctcgtggctcccaggtaccagtcttgtgacattacctaaattgacccagtctccatcctcctgtctgcatcgtattggagacagacgtcgaccagtcacttggccgggngagtcaggccatcagcgtattctttagccttggttgcagcaacgaaaccgacgggaccgacgcccctacgaggagtcgtagttctagtcgtgctatccagtattggacgtaagggtcgggtaccagtccaggttcaggtggacaggtgacgtagtcgtagggactagtactttaaccgacgttacctactaaacttactacgaacgtaccgtaacgtcccgttagtaccctaaggtacccttaaaggtaacggttttactttaacgtaactttaacgtttttaacttaaccgttacgtaaaccgttaaacgttaacgtttaagtttaaccgttaacccgtttaaccccggtttaggttaccgggttaaccggttaccggggaccggtaaacgggggtaaccgtaaacgggtaacggttaaaccgttaacccgtaaacccggttaacgttcggttacggtccgtacgtacccg

SEQ ID NO: 214513 - DNA, 395 bp, Homo sapiens
  misc_feature: GYAE6OF01C73SO.1.34.D01.1.454.CMB.1.raw
  modified_base (346)..(346): a, c, t, g, unknown or other
  misc_feature (346)..(346): n is a, c, g, or t
  modified_base (386)..(395): a, c, t, g, unknown or other
  misc_feature (386)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaaattttattactgtacaactagtattatacgtacccctagtggacgttcggccagtcggaccaggtgaagtcaaccgatgtgctgcacatctgtcttcatcttcccgcatcngaacgctactcgtctgagcgggctggacaaggcacatagnnnnnnnnnn

SEQ ID NO: 214514 - DNA, 718 bp, Homo sapiens
  misc_feature: GYAE6OF01BROS1.1.34.D01.1.454.CMB.1.raw
  modified_base (102)..(102): a, c, t, g, unknown or other
  misc_feature (102)..(102): n is a, c, g, or t
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttncagcaagaaaccagggccgacgcccctgagactcgtagtctagtggtgacatccagtattggacgtaaggggtcgggtacccagtcccgaggttcgaggtcggctaggtcgacgtagttcggtacggggaactaaggtacttaaccgtaccgttacctaccgtaaaccttacgtaccgacggaccgtaacgcccgtttaggacccgtaacggtcccgttaaaggtaaacggtttaactttttacggaacttttaaagttttttaacgttaaccgttagttaaccctaaaacgttaagtttaactttaacgttaaccccggttaaccccgttaagggttccggtaaccgggttttcccgggaaaccgggttaacgggggaacccgttaaaggggtaggtaaaacccggttccggaaaacccggttaacggtttgggtaccggtacccgttacggtaaaccccg

SEQ ID NO: 214515 - DNA, 583 bp, Homo sapiens
  misc_feature: GYAE6OF01DUFJA.1.34.D01.1.454.CMB.1.raw
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttgccgggcgagtcaggccatcagcgtatttctttagccttggttgcagaccaagaaaccgagggccgacgcccctcagatcgtagtctagtggtgcatccagtattggcgaagggtcgggtacccagtcccgaggttcaggtggacgtagtgcagtcgtagggactagtattaccacttctacactnacgagcacgcctagcagcctaggtaattattttgaactttaattttactacttagtactaataacgtttacgttacttaccgtacccgttaggtacgggtccgttaccgggaccggtaacggggtaccgaaaggggttacgtaacgtaaccgtaaccggtacgtggtcggcgtcgtaaccg

SEQ ID NO: 214516 - DNA, 585 bp, Homo sapiens
  misc_feature: GYAE6OF01E2K0M.1.34.D01.1.454.CMB.1.raw
  modified_base (257)..(257): a, c, t, g, unknown or other
  misc_feature (257)..(257): n is a, c, g, or t
  modified_base (346)..(346): a, c, t, g, unknown or other
  misc_feature (346)..(346): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgacgaagggtcgggtcccatccgaggttcaggtggcagtgcatcgtgggacagtacttacnctctcactatcagcagcctgcagcctagaagttatttgacttaatttacttacgtgtactaactagttaacttacgtaacgtaccccttagggttacggtaccggttccggacccgggtaacggggtaccgtaaggggttacggaaacggtacccgaaaaccggtacgttaggtcggtactacggaccaaccctagttccgttcgttacctttacctactttcccgttccccgtacccg

SEQ ID NO: 214517 - DNA, 510 bp, Homo sapiens
  misc_feature: GYAE6OF01AMMOH.1.34.D01.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (401)..(401): a, c, t, g, unknown or other
  misc_feature (401)..(401): n is a, c, g, or t
  modified_base (503)..(503): a, c, t, g, unknown or other
  misc_feature (503)..(503): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtncatccagattgacgaaggtcggggtccccagtccgaggttcaggtggcaggtgcagtcgtgggacagattacactctcactatcagcagcctgcagctagatntttagctaatttattactgtacaatagtaattatacgttaccctggtacgaccgttcggccgaggggaccgaggtaggaataccgaaccgtactaggtggcngtacccg

SEQ ID NO: 214518 - DNA, 564 bp, Homo sapiens
  misc_feature: GYAE6OF01EAP3T.1.34.D01.1.454.CMB.1.raw
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (355)..(355): a, c, t, g, unknown or other
  misc_feature (355)..(355): n is a, c, g, or t
  modified_base (437)..(437): a, c, t, g, unknown or other
  misc_feature (437)..(437): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggnagtcaggccatcagcgtattcttagcctggttncagcaagaaaccgngggcacgcccctnagatcgtagtctatggtncatcagtattgacgaaggggtcgggtcccagtccgaggttcaggtggcaggtnctagtcgtagggactagtacttaccacttcctacgaacttatcgaagtaccgacgtccctggaccagtcctaggtaaagttnttttagacttaattttactactgtaccaagtaagttattactacgtacccgttaggtcggtaacgttcggaccgaaggggacctaaggggtacgaacgtacccgaaacggtactggcgtcgtcgacc

SEQ ID NO: 214519 - DNA, 639 bp, Homo sapiens
  misc_feature: GYAE6OF01B63JB.1.34.D01.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttgccgggnagtcaggccatcagcgtattcttagcctggttgcagcagaaaccgagggcacgcccctnagatcgtagtctagtggtgcatccagtattggacgtaagggttcgggtacctagtccgtaggttcaggtggcaggtcgactagtcgtagggacagtacttacgaccttctacgtacttagtcaacgctaacgtcctagacctacgcccttagtaacgttatttttacgaacttaaatttttaactaccgtagttaaccctaaagttacgtttaactttacgtaaccggttaccccgttaagggttccgggtaacccgggtttccgggaacccggtaagggggtaaccctaaacgggggtaccggtaaaaacccgaaacgggtaaccgttgggtaccggtacgttacggacctaaacccg

SEQ ID NO: 214520 - DNA, 680 bp, Homo sapiens
  misc_feature: GYAE6OF01CU3V9.1.34.D01.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (388)..(388): a, c, t, g, unknown or other
  misc_feature (388)..(388): n is a, c, g, or t
tcagacgagtgcgtcacgaccggtgctcgatttagatcgtctgtgttgggtttgggggagtcagaccctgtcaggacacagcatggacatgacgggtccccntcagctcctggggctcctgctgctctggctcccaggtaccagctgtgacatccaattcgacccagtctccatcctcctgtctgcatctatgganacngagtcacntcactgccggcagtcaggccatcgaagcgtattcgtttagccttggttgcagcaaggaaccgagggctacgccccgtacagtactcggtagtctagtggtcgacacgtacagtagttcgacgtaaaggggtcgggtaccccaagtacccgtaacggttcgaacggttcgggactaacggtntaccgtaagttcgtacggggaactacgttaatttaaccacttctaccgtaacgttactaccgagtactacgtccgttagccgacgtccgttaggtaaagtttacttttacggacttttaaattttacggttaccttacggttaacaaaccgttaagttaaccgtttagtaacccgttaaaccccgtttaggtaccggttacggttacccgggaccggtaaagggggaccgttaaagggtaccgggtaaagttacccgaaaccggttaacgtacggttcggccgtcggtaccc

SEQ ID NO: 214521 - DNA, 570 bp, Homo sapiens
  misc_feature: GYAE6OF01AG7M2.1.34.D01.1.454.CMB.1.raw
  modified_base (270)..(270): a, c, t, g, unknown or other
  misc_feature (270)..(270): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcagaaccgngggcgacgcccctgagatcgtagtctagtggtgacatccagtattgacgtaaggggtcgggtacccagtccgaggttcaggtggcagtgctagtcgtagggacagtattaccactctactactatcagcacgcctgccacgtcctagtaagttattttcgaactttaatttaacttactagtaacaacgttagttaacttactaccgttaccccgtagggttacggtaccgttccgggaccggtaggggaaccctaaggggtacgaacgtaccgaaaccggtacgtaggcgtctcgaccc

SEQ ID NO: 214522 - DNA, 677 bp, Homo sapiens
  misc_feature: GYAE6OF01CRHAJ.1.34.D01.1.454.CMB.1.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttggccgggcgagtcaggccatcagcgtattctttagcctggttgcagcaacgaaaccgnggggcacgcccctacagatcgtagtctagtggtcgcatccagtattcggacgtaaggggttcgggtaccccagtccgaggttcaggtggcgaggtgacgtagtccgtaggggactaaggtaactttaccgaccttcctaccaacttaactccgaacgtccacgtcccgtagacctaccggacctaagggtaacgtagtttttacggactttaaacttttaacgtttaaccgtacgttacctaacttaacgtttaatttaaccgttaaccggttacccccgttaacgggtacggggttaaccggttacccgggaaccggtaacgggggtaacccggtaaaggggttccgggaaaacggttcccgaaaacccgggttaacgttcgggttacgggcctcggtaacccg

SEQ ID NO: 214523 - DNA, 568 bp, Homo sapiens
  misc_feature: GYAE6OF01EN23I.1.34.D01.1.454.CMB.1.raw
  modified_base (320)..(320): a, c, t, g, unknown or other
  misc_feature (320)..(320): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggcgagtcgaggccatcgagcgtatttctttagccttggttgcagaccgaagaaaccgaggggccgacgcccctacgagacttcggtagtctagtggtnctactccagtattcgacgtaaggggtcgggtacccagtaccgaggttcaggtcgcgtagtcgctagtcgtagggacagtattaccacttctactactactcacgcacgcctgccagcctaggaattatttcgattaatttaatactagtacaactattattaactaccgtacccgttagtacggtacgttccggacggtagggaactagggtagaaacgacgtaacccgaagttgtacggtctgaccg

SEQ ID NO: 214524 - DNA, 597 bp, Homo sapiens
  misc_feature: GYAE6OF01ATM4B.1.34.D01.1.454.CMB.1.raw
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (387)..(387): a, c, t, g, unknown or other
  misc_feature (387)..(387): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttcncagacaagaaaccgagggcgacgcccctnacgatcgtagtctagtggtacgcatccagtattgacgtaaggtcgggtcccagtccgaggttcagtggcagtgcagtcgaggacagtattacactctnactatcagcacgcctcgacgacgcctagtaagttatttacgacttaaattttactactagttaaccaaacgttaacgttaactttaacgtacccgttacccgtaacggtacgggtaacccggttccgggaccggtaacggggaacgtaaacggggtacgggtaaaccgtaaccgtaaaccgggtacgtgggttaccggcgtcggtaaccc

SEQ ID NO: 214525 - DNA, 687 bp, Homo sapiens
  misc_feature: GYAE6OF01DK3DT.1.34.D01.1.454.CMB.1.raw
  modified_base (289)..(289): a, c, t, g, unknown or other
  misc_feature (289)..(289): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacttgccgggcagtcaggccatcagcgtatttctttacgccttggttcgcagcaagaaaccgaggggcgacgcccctnagtactcgtagtctagtggtcacagtccagtagttcgacggtaacggggtcggggtaccccaagtcccgtaacggttcaggtcggctaggtcgacagtcgtacgggactagtacttacctacgttctaactaccttaacgtacacgtaccgtacgacccgttagaccgtaacgtcccgttaagtaacggttaactttttacggaactttaaagtttttaacttacgtacgtttaccaaaacgtttagttaaacttttaacgttaacccggttaaccccgtttaagggtaccgggttaccgggtttaccggacccgggtaaacggggttaaaccggaaggggttacgggtaaacgttacccggaaaacggtacgttagggtcggtactcgggtaacccc

SEQ ID NO: 214526 - DNA, 488 bp, Homo sapiens
  misc_feature: GYAE6OF01E0EF0.1.34.D01.1.454.CMB.1.raw
  modified_base (281)..(281): a, c, t, g, unknown or other
  misc_feature (281)..(281): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccgaggttcaggtggcagtgcatcgtgggacagtattacactctcactatcagcagcctgcagcctagaagtntttgactaagtttatactgtacaactagtattatacgtaccctaggtgacgttcggcgagggaccaggtgaatcgaacgactgtgctgac

SEQ ID NO: 214527 - DNA, 701 bp, Homo sapiens
  misc_feature: GYAE6OF01A9O5A.1.34.D01.1.454.CMB.1.raw
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatgagggtccccgctcagctcctggggatcctgctgctctggcctcccaggtaccagctgtgacatccaattcgacccagtctccatccctccctgtctgcatctattggagacagagtcaccatcacttggccggcagtcaggccatcagcgtattcttagcctggtgcagcaagaaaccgngggccgacgccccgtnacgtataccggtagtctagtcgggtnaccgtatccgagtagttcggacgtaaggggtccgggtaccacgtccggtaggttcgaggtcggcaggtcgcacgttcgtagggacctaggtaactttaccgaccttacgtactaacttagtccgaagtccaacgtcccgtcgacgaacgtacccgttaggtaaacgtttattttacgtaacgtttaattttaacgttaacgttacgttaacctaaacgttaacgttaacttttaaccggtaaacccgtttacccccggttaacggttaccgggtaaacccggtttaccgggacccgggttaagggggaaacccgtaaagggggttaccggaaacccggttaacgtaaaccccgggtaattaccgggtacggtacgttaacgggtaccc

SEQ ID NO: 214528 - DNA, 575 bp, Homo sapiens
  misc_feature: GYAE6OF01CDIIV.1.34.D01.1.454.CMB.1.raw
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (445)..(445): a, c, t, g, unknown or other
  misc_feature (445)..(445): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattggagacagagtcaccatccacttggccgggtcgagtccgacggccatcgagcgtatttctttagcctggttcgcagacaaggaaaccnggggccgacgcccctnagatcgtagtctagtggtcncatccgagtattggacgtaagggtcgggtcccatcccgaggttcgaggtcggctaggtgctagtccgtgggaactagtacttacctactctacactatcgacgcacgcctgcagtccgtagaagttnttttacgattaactttagttactcgtaacaacttagttacttacgttaccgtacccgtaggtcgtaccggttcggaccgtaggggaactagggtacggaaataccgaaccgtacgtggtcgtcgtgaccc

SEQ ID NO: 214529 - DNA, 677 bp, Homo sapiens
  misc_feature: GYAE6OF01DU9BO.1.34.D01.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (328)..(328): a, c, t, g, unknown or other
  misc_feature (328)..(328): n is a, c, g, or t
  modified_base (502)..(502): a, c, t, g, unknown or other
  misc_feature (502)..(502): n is a, c, g, or t
  modified_base (668)..(668): a, c, t, g, unknown or other
  misc_feature (668)..(668): n is a, c, g, or t
tcagacgagtgcgtcacgaccggtgctcgatttagatcgtctgtgttggggtttgggggagtcagaccctgtcaggacacagcatggacatggacgggtcccccgctcagctccgtggggctcctgctgctctggcctcccaggtaccagctgtgacatccaattcgacccagtcctccactccctccctgtcngcatctagtgganacagacgtcaaccatccgtacgttcggccgggacaagtcgaacggccatcgaagtcgtaattcgttacgccgtggtcgccagaccgaacggaaaacccgaggggacgaaccggtcccctanaggtatccgtagtctagttcggacacctaatccgaagtacgttggacggtaacggggtcgggtacctaacgtaccgtaggttaccaggtcgataggtcgacagtcgagggactacgtatactactgtacatacgtcgactcgcgtacgacgccgtaagtcctaaggtaaatttnttacgaactttaacgtttataaccgtgtaaacccaagtaaggtttaactaacgttaaccgtaacccgttacgggtacgtacccggggttacggacccgggtaaagggaacggtaaaacgggtccggtaaaacggacccgttaaaccggaagttcggttacgggacncggtaaccc

SEQ ID NO: 214530 - DNA, 605 bp, Homo sapiens
  misc_feature: GYAE6OF01C53S9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctgctcccaggtaccagctgtgacatccaattgacccagtctccatcctccctgtctgctatctatggagacagagtcacatcacttgaccggcgagtcaggccatcagcgtattcttagcctggtgcagcagaaccagggcgacgcccctcagatcgtagtctagtggtgcatccgagtagttgcgaaggtcgggtacccatccgaggttcaggtggcagtgcagtcgtaggactagtactaccacgtctaccatactcagtacacgtcctgaccacgtcctagtaacgtgttttacgacttaaattttaaccttacgttacgtacctaacgttaactttaatttaacgttaccgttaaccccgttacggttaccgggtaccggttaccgggaccgggtaagggggtaaccccgtaaggggtaacgggtaaaccgtaccgtaaaccgggtaacgttggttacggcgttcggaaccccg

SEQ ID NO: 214531 - DNA, 573 bp, Homo sapiens
  misc_feature: GYAE6OF01B89VL.1.34.D01.1.454.CMB.1.raw
  modified_base (565)..(565): a, c, t, g, unknown or other
  misc_feature (565)..(565): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaaattgacccagtctccatcctccctgtctgcatctattggagacagagtcaccatcacttgccgggcgagtcaggtcatcagcgtattctttagcctggttgcagcaagaaaccgagggcgacgcccctcagatcgtagtctagtggtgcatccagtattgacgaagggtcgggtccccagtccgaggttcaggtcggcagtgcagtcgtagggactagtacttaacacttctacaactatcagcagcctgccagccttaggaatattttcgacttaaagttttacttactacgtactaaactaggttaattacgtaaccgttaccccgttaggtcggtaaccgttccgggaccgtaacggggtaaccgaaaggggtggaaacgttaccgaaaccgtacgttggtcggngtcgaccg

SEQ ID NO: 214532 - DNA, 570 bp, Homo sapiens
  misc_feature: GYAE6OF01ENXPQ.1.34.D01.1.454.CMB.1.raw
  modified_base (231)..(231): a, c, t, g, unknown or other
  misc_feature (231)..(231): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccagggcgacgcccctcagatcgtagtctagtggtgcatccagtattgacgaagggtggggtcccatccgaggttcaggtggcagtgcagtcgtagggacaggtacttacacttctctaactatcagacagcctgccagtccgtagtaagtattttagacttaattttacttactgtacaagtagttaattactacgttaacccgtaggtacggtacgttaccggaccgtaggggtaaccgtaagggtcggaacgtaccgaaaccgtacgttcggtcggtactgaccacctagtccttcgtacctttacacttcccgtccccgtaccccg

SEQ ID NO: 214533 - DNA, 526 bp, Homo sapiens
  misc_feature: GYAE6OF01BF1A2.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcagaaaccagggcgacgcccctcagatcgtagtctatggtgcatccagattgcaaggtgggtccatccgaggttcagtggcagtgcatcgtgggacagattacactctcactatcagcagcctgcagcctagaacgtatttgctaatttatactgtacaactagttattactacgttacccctagttcggaccgtttcggaccgtaaggggaccctaagggtacggaaagttacccgaaaccgtaacgtaggtcggtcgtcgaaccg

SEQ ID NO: 214534 - DNA, 846 bp, Homo sapiens
  misc_feature: GYAE6OF01CXG5H.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctctggcctcccgaggtaccagctgtgacactaccaattcgacccagtcctccactccctccctgtctgctacttctagttggacgacagacgtacacctatcctacgttcggacccgggtacgacgtccgacgggaccagttaccgacggtaccgttacttttaccgttttacggccgtttagggttcgaccgaacggaccgaaacggaaacccggacggggaccggaacccgtacccccgtacgtaacgtacgttcggttaacgttcgttagttcgggtcgtacctacgtaccgaaggtacttacggaccggtaaacggggttccgggtaacccctacggttacccggtaacggtttacgaacggggttcggacggtaaggttcgtaccgttaacggttacgggttaacggggaacctaacgttaacgtttaaccacctttccgtaacttaacgtacgtacgaacgccgtaccggtacctggacctacggtacctaggttaaagttttactttacgtaacgtttttaacttaacggttacttacggtaaaccgttaaattacgtttaaactttacggtaaaccccggttacccttaacgggtacgggtacccgggttacccgggaaaccggggtaaggggtaacccggaaaggggttaacccgtaaaccggttacggaaacccgttagggttacgggaccgttcggaccgtaacccg

SEQ ID NO: 214535 - DNA, 567 bp, Homo sapiens
  misc_feature: GYAE6OF01CFRWN.1.34.D01.1.454.CMB.1.raw
  modified_base (283)..(283): a, c, t, g, unknown or other
  misc_feature (283)..(283): n is a, c, g, or t
  modified_base (559)..(559): a, c, t, g, unknown or other
  misc_feature (559)..(559): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaaccgagggcgacgcccctnagactcgtagtctatggtgcatccagtattggacgaaggggttcggggtcccctagtccgaggttcaggtggctaggtcgcagtcgtagggactagtacttacactctacactactcgacgcagcctagcacgtcctagtaacgttatttacgacttaatttacttactgtactaactagttattactaacgttacccctaggtcggtaccggttacggaccggtaaggggacccgtaagggtacggaacgtaccgaaaccggtacgtaggtcggngtcggacc

SEQ ID NO: 214536 - DNA, 542 bp, Homo sapiens
  misc_feature: GYAE6OF01C2YXP.1.34.D01.1.454.CMB.1.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattatttagcctggttgcagcagaaaaccngggcgagcccctcagatcgtagtctatggtgcatccagattgcaaggtcgggtcccagtccaggttcagtggcagtgcatcgtgggacagattacactctacactatcaagcagcctgcagcctagaaagtnttttagactaaattttataacttgtactaactagttaatttactaacgtaccccttagtacggtacgttacggaccgtaaggggacccgaagggttacggaacggtaccaaaccggtaacgtggtacggtcctgtaacccg

SEQ ID NO: 214537 - DNA, 604 bp, Homo sapiens
  misc_feature: GYAE6OF01CHWAT.1.34.D01.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
  modified_base (585)..(585): a, c, t, g, unknown or other
  misc_feature (585)..(585): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattcgacccagtctccatcctccctgtctgcatctattgganacagacgtcaccatcacttgccggcgagtcaggccatcagcgtattcttagcctggtgcagcagaaaccgngggcgacgcccctgagtactcgtagtcgtagtggtcgcatccagtattcggacgtaaggggtcgggtacccagtcccgaggttcaggttcggactagtcgactagtcgtgggacagtacgttaccacttcgtactactatccgagccagtcctgtcacgcctagtaaacggttattttcgaagtttaaacttttaacgttaccgtagttaacctaaagtagtttaactttaacgtaaccgttaccccgttaggtcggtacgttaccgggccgaagggggaaccctaggggtacgtaaggtacccgaaccgttaacgnggtacggccgtgtaacccg

SEQ ID NO: 214538 - DNA, 595 bp, Homo sapiens
  misc_feature: GYAE6OF01ESWVL.1.34.D01.1.454.CMB.1.raw
  modified_base (170)..(170): a, c, t, g, unknown or other
  misc_feature (170)..(170): n is a, c, g, or t
  modified_base (245)..(245): a, c, t, g, unknown or other
  misc_feature (245)..(245): n is a, c, g, or t
  modified_base (355)..(355): a, c, t, g, unknown or other
  misc_feature (355)..(355): n is a, c, g, or t
  modified_base (558)..(558): a, c, t, g, unknown or other
  misc_feature (558)..(558): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctcctgtctgcatctatgganacagagtcaccatcacttggccgggcagtcaggccatcagcgtatttctttagcctggttgcagcaagaaaccgngggcgacgcccctgagatcgtagtctagtggtgcatccagtattgacgaagggtcgggtaccctagtcccgtaagggttcaggtcggctagtcgactagtcgtacggganacgtacttacactctacgtactatacagcacgcctagcagtcctagtaacgttatttcgacttaatttacttacttagtacctaagtagtttaacttaacgtaccgttaacccgttaggtcggtaccggttacgggaccggtacgggaaccgtaaggacggtactaccgtaacgaacgttggacggtcctacggacctacgtntaccgttagtcccttatcccttccctccccgtacccg

SEQ ID NO: 214539 - DNA, 483 bp, Homo sapiens
  misc_feature: GYAE6OF01D3JP5.1.34.D01.1.454.CMB.1.raw
  modified_base (235)..(235): a, c, t, g, unknown or other
  misc_feature (235)..(235): n is a, c, g, or t
  modified_base (444)..(483): a, c, t, g, unknown or other
  misc_feature (444)..(483): n is a, c, g, or t
tcagacgagtgcgtcacgaccggtgctcgatttagatcgtctgtgttgggggtttgggagtcacggccatcgagcgattctttagccgtggttgcaggccagaaaccagggcgacgccccgtcagatcgtagtctatgggtgcatccagattgcaaggtgggtcccatccagttcagtggcagtgcatctgggacagattacgactctcactatcagcagcctgcagcctgaagnttttgactaatttattacttgtcaaactagtatatagtaacccctacgtaggaccgttccggacaggggacccaagggtgaagtaccgaaccggtaactggtcggctagtaccaccgtatccgtagttccttacacttcccttcccggacagttccgtagaaccgcactcgtacgtgtacggccggtctggaccaagggcacaggtacnnnnnnnnnnnnnnnnnnnnnnnnnnnnnnnnnnnnnnnn

SEQ ID NO: 214540 - DNA, 523 bp, Homo sapiens
  misc_feature: GYAE6OF01B03UU.1.34.D01.1.454.CMB.1.raw
  modified_base (254)..(254): a, c, t, g, unknown or other
  misc_feature (254)..(254): n is a, c, g, or t
  modified_base (380)..(380): a, c, t, g, unknown or other
  misc_feature (380)..(380): n is a, c, g, or t
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattctttagcctggttgcagcagaaccagggcgagcccctnagatcgtagtctatggtgcatccagtattgacgaagggtcggggtacccagtccgaggttcagtggcagtgcatcgtgggacagacttacactctacactatcagcacgcctgcagcctagaagtntttgacttaatttattactgtacaagtattacttaatacgtaccctaggtcgacgttcggacgagggaccaaggtcgaagtaccgaacgtaacgtcgtacggctacggcncctagtccgttntctttnacttcgtccccgtac

SEQ ID NO: 214541 - DNA, 711 bp, Homo sapiens
  misc_feature: GYAE6OF01DA5B1.1.34.D01.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctatgganacagatcaccatcacgttggccgggngagtcaggccatcagcgtattcttagctggtncagcaagaaccgngggcgacgcccctnagactcgtagtctagtggtcncactccgagtagttcggacgtaaggggtcgggtacccagtcccgtaggttcaggtcggctaggtcgcgtaagtccggtagggaactaagtaacttaaccacttcctaactaacttataccgaacgtccgaacggtccctacggacctaacggtcccttaaggtaaacggtttactttttacggaacctttaaagtttttaacgttaaccgtaggtaaacctaaaacgttaacgtttaaactttaaccgttaaccccgttaaccccggttaacgggttaccggggtaacccgggtttacccggggaacccgggtaaacggggggtaaaccccgtaaagggggttacgggtaaaaccgttaacccgaaaacccgggtaacgttagggtacggtacccgtacggtaaccc

SEQ ID NO: 214542 - DNA, 595 bp, Homo sapiens
  misc_feature: GYAE6OF01APR6M.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcaagaaaccgngggcgacgcccctcagatcgtagtctagtggtgcatccagtattgacgtaagggtcgggtccagtccgaggttcagtggcaggtcactagtcgtgggaactaggtacttacactctactaactactacacgacaacgccctcgaccgacgtcccgtagtaaacgttattttcgaactttaaattttacttacgtagttaccaaacgttagttaacttaagtaccgttaaccccgtaggtaccggtaacggtttccgggaccggtaacggggaaccgtaaagggtacggaacgttaccgaaaccggtactaggtcggctcggtacccg

SEQ ID NO: 214543 - DNA, 413 bp, Homo sapiens
  misc_feature: GYAE6OF01AXFBX.1.34.D01.1.454.CMB.1.raw
  modified_base (405)..(413): a, c, t, g, unknown or other
  misc_feature (405)..(413): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtggggtcccatccaggttcagtggcagtgcatcgtgggacagattacactctcactatcagcagcctgcagcctgaagtattttgactaattttattactgtacaactagttattatacgtaccctaggtggaccgttcggccgacggggacctaaggtggaacgtcaaccgactggtggctgcaccatctgtctcatccttcccgctatcgtagacgcactcgtctggacggcgggctggacacggcgacatagnnnnnnnnn

SEQ ID NO: 214544 - DNA, 669 bp, Homo sapiens
  misc_feature: GYAE6OF01BRGZT.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgtatttctttagcctggttgcagcagaaaccgagggcgacgcccctacgagactcgtaagttctagtggtcgctatccagtactttggacgtaacggggttcgggtaccccagtcccgtaagggttcaggtcggctaggtcgactagtcggtagggactacgtaatttaccacgttcctactaaccttatccgaacgcgtaccggtcctcgccacgtccctaggtaaacgttatttttacgacttaaacgtttttacttacctacggttaaccaaacgttaagttaactttactaacccggttaccccgtacggttacggggttacccgttacccggggaccggtaacgggggtaaccgtaaagggggttaccgggtaaacggttaccgaaaacccggttaacgttagggtccggttacgtacccggtacccg

SEQ ID NO: 214545 - DNA, 576 bp, Homo sapiens
  misc_feature: GYAE6OF01BWEAJ.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttgccgggcgagtcaggccatcagcgattctttagcctggttgaagcagaaaccngggcgagcccctnagatcgtagtctagtggtgcatccagattgacgtaagggtcggggtcccagtccgaggttcaggtggcagtgcatcgtagggacagtacttacacttctacactatcagcagcctgcagcctagaacgttnttttcgacttaatttattacgtgtactaacgtattaacttactaccgttaccccgtaggtacgggttaccgttaccgggaccggaacgggggtaaccctaaggggtacggtaaacggttaccgaaacccggtaacgttcgggtacggtcgttcggccgtaacccg

SEQ ID NO: 214546 - DNA, 667 bp, Homo sapiens
  misc_feature: GYAE6OF01CT5QX.1.34.D01.1.454.CMB.1.raw
  modified_base (277)..(277): a, c, t, g, unknown or other
  misc_feature (277)..(277): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctatggagacagagtcaccatcacttggccgggcgagtcaggccatcgagcgtatttctttagccttggttgcagcaagaaaccgnggggccgacgccccctacagactcggtagtctagtggtncatccagattcggacgtaacggggtcgggtacccagtcccgtaggttcaggtcggctaggtcgactagtcgtagggactaggtaacttaccaccttactaccaacttactcgaagaccacgtccctacggacctacggtaccttaaggtaaacgtttacttttaggaaccttttaaagtttttacttacgttacgtactaaacttagtttaactttacgtaacccgttaacccccgttaagggttaccgggtaccggttaccgggaaccggtaacgggggaacccgtaaaggggtacggtaaaccgtaccgtaaaacccggtaacggttgggtacggtccgtcggaacccg

SEQ ID NO: 214547 - DNA, 590 bp, Homo sapiens
  misc_feature: GYAE6OF01BJ6Z5.1.34.D01.1.454.CMB.1.raw
  modified_base (104)..(104): a, c, t, g, unknown or other
  misc_feature (104)..(104): n is a, c, g, or t
  modified_base (272)..(272): a, c, t, g, unknown or other
  misc_feature (272)..(272): n is a, c, g, or t
  modified_base (429)..(429): a, c, t, g, unknown or other
  misc_feature (429)..(429): n is a, c, g, or t
tcagacgagtgcgtcacgaccggtgctcgatttagatcgtctgtgttggggtttgggggagtcagaccctgtcaggacacagcatggacatgacgggtccccgntcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcaagaaaccgngggcacgcccctagagatcgtagtctagtggtgcatccagtatcgacgtaagggtcggcccatccgaggttcaggtgcagtgcagtcgtgggacagtacttacacttctactactactacgagcaacgcctagacctacggacctaggtaaacgttntttttacggacttaaattttacgtacgtacgtactaaacgttagttaacttacgtaaccgttaccccgttaggttacggtaccggttaccggaccgtaagggggaaccctaaggggtacgaaacgtaccgtaaaccgtagtcggtacggtccgtggaaccc

SEQ ID NO: 214548 - DNA, 520 bp, Homo sapiens
  misc_feature: GYAE6OF01CFFXU.1.34.D01.1.454.CMB.1.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (417)..(417): a, c, t, g, unknown or other
  misc_feature (417)..(417): n is a, c, g, or t
  modified_base (515)..(515): a, c, t, g, unknown or other
  misc_feature (515)..(515): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcgagtcaggccatcagcgattctttagcctggttgcagcagaaccngggcacgcccctnagatcgtagtctagtggtgcatccagtattgcgtaaggggtcgggtaccccagtccgaggttcaggtcggcagtgcagtcgtaggggacagtacttacactctacactatacagcagcctagcagtcctagaattnttttacgacttaatttatactgtacaactagttacttatacgtacccgtgtacgtacgtcggcgtagggactaggtgaacgtcaaaccgtagtgtcgntgacc

SEQ ID NO: 214549 - DNA, 403 bp, Homo sapiens
  misc_feature: GYAE6OF01AP4Y2.1.34.D01.1.454.CMB.1.raw
  modified_base (379)..(379): a, c, t, g, unknown or other
  misc_feature (379)..(379): n is a, c, g, or t
  modified_base (386)..(403): a, c, t, g, unknown or other
  misc_feature (386)..(403): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgactaatttatactgtcaacagtattatacgtacccctacgtggacgttcggccagggggaccaaggtggaacgtcaaccgaatgtggctgcaccgatctgtctcatcttccgcatctgaacgcactcgtctgagcggctggcaaggcncagtagnnnnnnnnnnnnnnnnnn

SEQ ID NO: 214550 - DNA, 617 bp, Homo sapiens
  misc_feature: GYAE6OF01A6R64.1.34.D01.1.454.CMB.1.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattgacccagtctccatcctccctgtctgcatctatgganacagagtcaccatcacttgccgggcagtcaggccatcagctattcttagcctggttncagcaagaaaccgngggcgacgcccctagagtatcgtagtctagtggtnctatccagtattcggacgtaagggtcgggtacccagtccgaggttcaggtggacagtgctagtcgtagggactagtacttaccacgttctacaacttacgtacgaacgcgtaacgcccgttgaccgtacgtacccgttaggtaaagtttacttttacggaactttaattttaacgtacgttacgttaacctaaagttagttaacttaacgttaacccgttacccgttacgggtcggtaaccggttcggaccggtaacggggaacgtaagggtacggaacgtaccgtaaccggtacttagggtcgtcgtggaccc

SEQ ID NO: 214551 - DNA, 752 bp, Homo sapiens
  misc_feature: GYAE6OF01CK3Y6.1.34.D01.1.454.CMB.1.raw
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagtggagacagagtcaccatcacttcggccgggcgagtcgaggccatcagcgtatttcttacgccttggttgcagcaagaaccgngggcgacgcccctacgagactcgtagttctagtggtcgactagtaccagtacgttcggacgtaagggtcgggtacccagtcccgtaggttccgaaggtcggacgtaggtgaccgtagttcggtagggaactaaggtaacctttaaccgtaccttaccttaacctaacttactaccgaacggtacctaacgtcccgtacggaccgtaccggtacccgttaaggtaaacgtttacgtttttacggtaactttaaacgtttttaacgttaccgttaacggttaaccttaaacgttaagtttaacgtttaaccgttaaaccccggtttacccccggttaacgggtaccgggttaacccggtttaccccggggaaccgggttaaacccggggggtaaccggtaaacgggggttaaacggtaaaaccggttaccccggaaaaccggttaacggttcgggtacgggtccgtaccgggtaaccc

SEQ ID NO: 214552 - DNA, 682 bp, Homo sapiens
  misc_feature: GYAE6OF01A2HYR.1.34.D01.1.454.CMB.1.raw
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (635)..(635): a, c, t, g, unknown or other
  misc_feature (635)..(635): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (680)..(681): a, c, t, g, unknown or other
  misc_feature (680)..(681): n is a, c, g, or t
tcagacgagtgcgtcacgaccggtgctcgatttagatcgtctgtggttgggtttgggagtcgaggccatcagcgattctttagcctggttgcagcagaaaccagggcgagcccctcagatcgtagtctatggtgcatccagattgcaagggtcggggtcccatcctaggttcagtggcagtgcatcgtgggacagtattacactctcactatcagcagcctgcacgcctagaagtattttgacttaattttacttacgtgtacctaaactagttaattacttaaccgtacccccttagggtacgggtaccggtttcccggggaccgaacggggggtaacccaaggggttacggggaacgttacccggaaacccggtaacggttgggttacggggaccttacggacccgaaccctaagtttccgttacggttacctttaccgactttacccgtttaccccccggaaccttaagtttacccgttaacgggtaaccggtcccttaaacccggtttccgggtaaccggttaacggggaccggggtccgggggttaccgtacggggacccgtaaacggggccgtaacgtaacgttacggatacgacacacgctgaccnancnancncgagacgacgacgngagacgacgacgacgtactatgngngangnananatacananatnnc

SEQ ID NO: 214553 - DNA, 555 bp, Homo sapiens
  misc_feature: GYAE6OF01DU4QA.1.34.D01.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcngcagaaaccagggcgagcccctcagatcgtagtctatggtgcatccagattgcgaaggtgggtcccatccaggttcagtgcagtncatctggacagatacactctacactatcaagcagcctgacagcctagaagttatttagactaattttacttacgtgtactaactagttacttaactacgtaaccccttaggtacggtaccggttcggaccgacggggtaacccaagggtaggaaacgttacgaaacccggtaatcggtacggtctacggccaacctgttaccttcgttaccttcaacttcccttccccgtaaccccc

SEQ ID NO: 214554 - DNA, 731 bp, Homo sapiens
  misc_feature: GYAE6OF01B7W6O.1.34.D01.1.454.CMB.1.raw
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattcgacccagtctccatccctcctgtctgcatctagtgagacagatcacatcacttggccgggcagtcaggccatcagcgtattcttagctggtncagacaagaacgaggcgacgcccctnagtactcgtagtctagtggtncactccgagtattcggacgaacggggtcgggtacccaagtcccgtaggtttacgaaggtggaccgaggttacgactacgttaccgaggggtaactacggtaactttaaccgaacttcctaacctaacttaacgtaccgaacggtacctaaccggtcccttagggacctaacggtacccgttaaggtaaaagtttcgtttttaacgaacttttaaacgttttaactttaaccgtagttaacctaaacgttaagtttaacgtttaacgttaacccgtaacccccgtttaaagggtcccgggttaaaccggtttaccggggaaccggtaaagggggggtaacccgtaaaggggggtttaaaccgtaaaaccgggtaacccgttaaaaacccgggtaaccgggtttaggtaccgggtaccgttacgaaaccccg

SEQ ID NO: 214555 - DNA, 532 bp, Homo sapiens
  misc_feature: GYAE6OF01BJYM3.1.34.D01.1.454.CMB.1.raw
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttggccgggcgagtcaggccatcagcgtattctttagcctggttgcagcagaaaccagggcgacgcccctnagatcgtagtctagtggtgcatccagattgacaagggtcggtcccatccgaggttcaggtggcagtgcagtcgtgggacagtacttacactcncactatcagcagcctgcagcctgaagtattttgacttaatttattactagttacaactagttaattactacgtacccttaggtcggtaccgttcggaccgtacggggacgtaagggtacggaacgtaccaaccggtacgtggtacggcgtcgaccg

SEQ ID NO: 214556 - DNA, 730 bp, Homo sapiens
  misc_feature: GYAE6OF01A3ENC.1.34.D01.1.454.CMB.1.raw
tcagacgagtgcgtcacgaccggtgctcgatttagatcgtctgtgttgggtttgggcatggacatgagggtcccgctcagctcctggggctcctgcctgctctggtctcccaggtaccagctgtgacatccaattcgacccagtctccatcctcctgtctgcatctattggagacagagtccacctatcgacgttggccgggcgtaagtcgacggcccatccgaagtccgtaatttcctttaagccttgggtttagacctagaccgaaacggaaaaccgaggggtccgtacgtaccccttgtaacggtactaccggtaagtactagtggtacgctactccgaagtacttacggcgtaacgggttcgggtaccctagtaccgtacgggttcaagggttcggacgtacggtcgacgtacgttcggtacgggaacacggtacttacgacttactacgtaacttacgtacgacgtactacgtaccctaggtaccacggtacccgttaaggtaaacgttacgttttacgaactttaagttttacgttaacgtcgtaacctaacgtaagtttaacttacgttaaccgtacccgttaggtacggttaaccgttaccgggtaccgtaacgggtaaccgtaggtacggtaacgtacccgaaacgttagttcggtacggtcgtacggtaaccaccgtattcgttacgttacgttaaccaccggtttcccttacccggacc

SEQ ID NO: 214557 - DNA, 403 bp, Homo sapiens
  misc_feature: GYAE6OF01D01B0.1.34.D01.1.454.CMB.1.raw
  modified_base (318)..(318): a, c, t, g, unknown or other
  misc_feature (318)..(318): n is a, c, g, or t
  modified_base (392)..(403): a, c, t, g, unknown or other
  misc_feature (392)..(403): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgctaaattttatactgtacaactagtatttatacgtacccctagtggacgttcggcgaggggaccaggtggaatcaaccgatgtgntgcacatctgtctcactctcccgctatctagaaccgcactcgtcagacggcgggctggaccaaggcgcaatagnnnnnnnnnnnn

SEQ ID NO: 214558 - DNA, 682 bp, Homo sapiens
  misc_feature: GYAE6OF01AI68Q.1.34.D01.1.454.CMB.1.raw
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggngagtcaggccatcagcgtattctttagcctggttgcagcagaaaccgngggcacgcccctnagactcgtagtctagtggtcgcatccaagtattcggacgtaaggggtcgggtacccagttcccgaggtttccaaggttcgggactaggtgactaagtcgtaggggaactaggtaactttaacacttctactaacttataccgagacaacgtcccgtagaccaacggtcctaaggtaacgtttatttttacgaactttaaagtttttacttaaccgttagttaacctaaacgttagtttaaacttaacgttaacccggttaacccccgttagggttacgggtaacccggtttaccgggaacccgggtaagggggttaaacccgtaaagggggttaacgggtaaacgttaacccggtaaaacccgggttaacggttagggtacggtaccgttacggaacccc

SEQ ID NO: 214559 - DNA, 580 bp, Homo sapiens
  misc_feature: GYAE6OF01CB91H.1.34.D01.1.454.CMB.1.raw
  modified_base (271)..(271): a, c, t, g, unknown or other
  misc_feature (271)..(271): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccgngggcacgcccctcagatcgtagtctatggtgcatccagtattcggacgtaaggggtcgggtcccagtcccgtaggtttcaggtggctaggtgctagtcgtgggactagtacttacactctacactancagcacgcctagcagtcctagtaagttattttagacttaattttaacttacgtacgtaactaactagttaacttaacgtaaccgttaccccttagggtcggtaccggttaccggccggtaacggggtaaccgtaagggtggtaaacgtaccgaaaccggtacgtcggttcggccgtcgaccc

SEQ ID NO: 214560 - DNA, 593 bp, Homo sapiens
  misc_feature: GYAE6OF01ARCEN.1.34.D01.1.454.CMB.1.raw
  modified_base (452)..(452): a, c, t, g, unknown or other
  misc_feature (452)..(452): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacttggccgggcgagtcgacggccatcagcgtattcgttacgccgtggttcgcagacaacggaaaccgagggccacgcccctagagtactcgtagtctagtggtcgcatcgagtacgttgacgtaaggggtcggtacccagtccgaggttacaggtcgctagtcgctatcgtaggtactagtacttaccactctacatactacgacgacacgccgtagaccgacgtacgtaggtaacttntttacgaactttaattttacttacgtacgtaactaaagttacgttaacttaccgtaaccgttacccgtaggttaccggtacgttccgggacgtagggaaccgtaggtacggaacgacgtaaccgagtggtacggctcgacc

SEQ ID NO: 214561 - DNA, 602 bp, Homo sapiens
  misc_feature: GYAE6OF01CBZEI.1.34.D01.1.454.CMB.1.raw
  modified_base (595)..(595): a, c, t, g, unknown or other
  misc_feature (595)..(595): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttcgcagacaaggaaaccgagggccgacgcccctcgagtatcggtagtcgtagtggtgacatccaagtattggacgtaaggggtcggggtacccagtacccgtacggttacaggtgggaccgtaaggtgacgtaacgttccggtaggggaactaggttaacttaccgtacgttcctacgtaacttactcgaacgcacgcctagaccagccgtagtagttatttagacttaatttatactatacaacgtattaacgttataaccggttaccacggttcggtaccggttcggacggacgggtaacgtaggtacggaactaccgtaacgacgtaggttccgntcgaccg

SEQ ID NO: 214562 - DNA, 549 bp, Homo sapiens
  misc_feature: GYAE6OF01EHEO2.1.34.D01.1.454.CMB.1.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (508)..(508): a, c, t, g, unknown or other
  misc_feature (508)..(508): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgacgcccctnagatcgtagtctagtggtgcatccagtattgacgtaagggtcggggtcccatccgaggttcaggtggcaggtgcagtcgtaggggacaggtacttaccgactcctactaactatcagcacgtcctagctacgcctagtaagtatttgacttaatttatactgtacaatagttattactacgttaccctagtacggtaccgttcggaccgaggggtaccaagggtgaataccgaaaccgtagtggtcgcgtcncacctatcgtacgttcttacgacttccgtccccgtaccccg

SEQ ID NO: 214563 - DNA, 644 bp, Homo sapiens
  misc_feature: GYAE6OF01DJ2OY.1.34.D01.1.454.CMB.1.raw
  modified_base (223)..(223): a, c, t, g, unknown or other
  misc_feature (223)..(223): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattcgacccagtctccatcctccctgtctgcatctatggagacagagtcacatcacttgccgggnagtcaggccatcagcgtattcttagccgttggttcgctagacaacggaaaccgagggccgacgcccctanagactcgtagtctagtggtncataccgagtagttggacgtaacggggtcgggtaccctacgtaccgtacggttcgaggtcggacgtaaggtcggtactaacggttcggtaggggaactaggtaacttacctaccttacctaccgtaacttacgtacgacgacgtaccgccgtgaccgtacggtccttaaggtaacgttattttacgtaacttaagttttactacgttagtactaaactagttaactttacgtaccgttaaccccgtaggtacggtaccggttaccgggacggtaacgggaaccggtaaggtacggtaaacgtaccgaaacgtacgtagcggtctcgtaacc

SEQ ID NO: 214564 - DNA, 640 bp, Homo sapiens
  misc_feature: GYAE6OF01BNRQY.1.34.D01.1.454.CMB.1.raw
  modified_base (277)..(277): a, c, t, g, unknown or other
  misc_feature (277)..(277): n is a, c, g, or t
  modified_base (368)..(368): a, c, t, g, unknown or other
  misc_feature (368)..(368): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctatcggagacagagtcaccatcacttgccgggcgagtcaggccatcagcgtattcctttagccctggttcgcagacaacgaaaccgnggggccgacgcccctacacgatcgtagtctagtggtgcatccgagtattggacgaagggtcggtcccatccgaggttcaggtggcaggtcncgatcgtggacagtattacaccgtctacacttatacgacgacacgtcccgtgccacgtcctaggtaacttagttttacgacgttaaattttattaccgtacgttaactaacttacgttaactttacgtaaacccgttacccccgttaagggttacccggttaacgggttacccgggaccggtaaccggggggaaacctacgggggttaacgggtaaaccgttaacccgtaaaacccggttacggttaccggtacgggccttagggaaccccc

SEQ ID NO: 214565 - DNA, 639 bp, Homo sapiens
  misc_feature: GYAE6OF01C6OCE.1.34.D01.1.454.CMB.1.raw
  modified_base (104)..(104): a, c, t, g, unknown or other
  misc_feature (104)..(104): n is a, c, g, or t
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagacccgtgtcaggacacagcatggacatggacgggtccccnctcagctcctgggctcctgctgctcgtggctcccaggtaccagctgtgacatccaattcgacccagtctccatccgtcctgtctgcatctagttggagacagagtcacatcacttgccggnagtcagccatcagcgattcttagcctggtgcagcacgaaccgnggcgacncccctnagatcgtatcgtagtcggtgactacgtacctagtagttcgacgaagggttcggtacccaggttccgaaggttcagggtcgacgagtcgcgtagtccgagggactagtacgtaactactaccgtacacgtaactcgtacgacctacgtaccctcggtaccgtacggttccgttaaggtaacgttacgttttacggaacctttaaagttttaacttaccgttacgtaacctaaacgttaacggttaacttaacgttaacccggttacccgtacggttacgggtaccgttccgggaccgtaacggggacctaacgggtacggtaacgaccgtaacgtaacgtgggtacggtcgcggtaccg

SEQ ID NO: 214566 - DNA, 572 bp, Homo sapiens
  misc_feature: GYAE6OF01DT2L0.1.34.D01.1.454.CMB.1.raw
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccagggcgacgccccctcagatcgtagtctatggtnctatccagattgacaagggtcgggtcccatccaggttcagtggcagtcgcatcgtagggaacagtacttaaccacttcctacaacttactcgaagcacgccctgcacgtcctagtaagttnttttagacttaaattttatacttagtactaaacttagttaatttactaacgttacccccgttaggtcgggtaccgttccggaccggtaaggggacctaaaggggtacggaacgtaccaaacccggtaacgttggacgggctcggaccc

SEQ ID NO: 214567 - DNA, 411 bp, Homo sapiens
  misc_feature: GYAE6OF01BTK4J.1.34.D01.1.454.CMB.1.raw
  modified_base (227)..(227): a, c, t, g, unknown or other
  misc_feature (227)..(227): n is a, c, g, or t
  modified_base (395)..(411): a, c, t, g, unknown or other
  misc_feature (395)..(411): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtnttttgactaatttattactgtcaaactagtattatacgtacccctagtggtacgttcggccagggggaccaaggtggaagtcaacgactgtggctgcacatctgtctcatctcccgctatctgaacgcactcgtctgacggcggtctggaccaaggccgacataggcnnnnnnnnnnnnnnnnn

SEQ ID NO: 214568 - DNA, 635 bp, Homo sapiens
  misc_feature: GYAE6OF01D9P5L.1.34.D01.1.454.CMB.1.raw
  modified_base (102)..(102): a, c, t, g, unknown or other
  misc_feature (102)..(102): n is a, c, g, or t
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctcctgtctgcatctatgganacagagtcactatccacgttgccgggngagtcgaggccatcgagcgtattcgtttagccgtggttgctagctaagaaaccgngggccgacgcccctgaggtacttcgtagtctacgtggtcgactagtaccagtacgttgacgtaagggtcgggtccctagtaccgtaggtttcgagtcggactagtggctaagtcgtagggaactacgtaacttaaccgcttacctgtaacttcgtaccaggtccacggtcccgtagccgtacgtccgtagtaagtttactttcgaatttaacgttttactaccggttagtacctaacgttaagttacttaacgttaccggttaaccctgggttaccggacctttccggggacttaacgggggaccttaaggggtacgtaaacgtacccgtaaaccgagtttgggcgcgttgtaacccg

SEQ ID NO: 214569 - DNA, 631 bp, Homo sapiens
  misc_feature: GYAE6OF01A5K3W.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccggcgagtcaggccatcagcgtattctttagccttggttgcagacgaacgaaaccgagggccgacgcccctgagacgtcgtacgtctagtggtcgctatccagtattgacgagggtcgggtccagtccgtaggttcagggtcggacgtagtcgactagttcgtaggggtaacaacggttaacttaccgtactccgtacctactaactacgacgctacgtacctggaccacgtccgtagtaagtttacttttagaacttaattttactacgtacgtaaccgtaacttagttaacgttaactacggttacccccgttaagggttcggtaaccggttccggaaccggtaggggaaccgtaggggtacggtaaaccttaccggaaacccggtaggttcgggtacgtcgtcgtaaccg

SEQ ID NO: 214570 - DNA, 526 bp, Homo sapiens
  misc_feature: GYAE6OF01C5RWL.1.34.D01.1.454.CMB.1.raw
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (414)..(414): a, c, t, g, unknown or other
  misc_feature (414)..(414): n is a, c, g, or t
  modified_base (521)..(521): a, c, t, g, unknown or other
  misc_feature (521)..(521): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgtattcgtttacgccttggttcgcagcaagaaaccgagggcgacgcccctnagtactcgtagtctatggngctactccaagtattcgacgtaacgggtcgggtaccagtcccgtaggttcgaggtggacaggtcgcgagtcgtagggacagtactacactactcactatcagcagcngcagcctagtatatttagactaatttatactgtacaatagttattacgtacgtacctacgtcgtacgtccggacgaggacgaggtagagtacgaacgtactggtacngtgac

SEQ ID NO: 214571 - DNA, 608 bp, Homo sapiens
  misc_feature: GYAE6OF01BOTP2.1.34.D01.1.454.CMB.1.raw
  modified_base (258)..(258): a, c, t, g, unknown or other
  misc_feature (258)..(258): n is a, c, g, or t
  modified_base (586)..(586): a, c, t, g, unknown or other
  misc_feature (586)..(586): n is a, c, g, or t
tcagacgagtgcgtcacgaccggtgctcgatttagatcgtctgtgttgggtttggtcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaaccagggcgacgcccctnagatcgtagtctatggtgcatccagtattggacgaagggtcggggtcccagtccgaggtttcaggtggcaggtgctatcgtgggaacagtacttacacttctacactatcagcagcctgcacgtcctagtaagtattttagacttaattttacttacgtcgtactaaactagtttaacttaacgttaccgtaaccccttagggttacgggtaccggtttaccgggaccggtaagggggaacctaaggggtacggtaaacgtaccgaaaccggtaacgtcgggtacggtcctacggaccaaccgtagttccttacggttacccttaccnctttccccgttaccccggtacc

SEQ ID NO: 214572 - DNA, 599 bp, Homo sapiens
  misc_feature: GYAE6OF01COTMZ.1.34.D01.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcaagaaaccngggcgacgcccctnagatcgtagtctagtggtncatccagtattggacgtaagggtcgggtacccagtccgaggtttcaaggtcggctagtcgcagtcgtagggacagtacttacactctacactancagcacgctgacacgtcctagtaacgttatttacgacttaagttttattactagtacaacgttagtttaacttacgttaaccgtaccccgttaggtacgggtacccggttaccgggacccggtaaaggggggtaccctaaggggttaacggtaaacgttaccgaaacccggttaacgtaggtccgggtactccggtaacccg

SEQ ID NO: 214573 - DNA, 613 bp, Homo sapiens
  misc_feature: GYAE6OF01A2HUS.1.34.D01.1.454.CMB.1.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
  modified_base (362)..(363): a, c, t, g, unknown or other
  misc_feature (362)..(363): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtggttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagacgtcaccatcacgttgccgggcgagtcaggccatcagcgtattcttagccttggttgccagcgaagaaccgagggcgacgccccncgagtntcgtagtctagtggacgcatccagtattgacgtaggggtcggtccagtcgaggttcaggtcgntagtnnagtcgnggtanagtataccnctctacatancaacncacgtccaggcacgtccgtataacgttatttacgactttaatttaacgttacgtacgttaacgtaactaagtttaacttacgtaacccgtttaacccggttacggtacgggttaacccgtttacgggaacccggtaagggggaacccgttaaacggggtacggaaacgttaacccggaaccgggtaaccttaggggacggtacttccggaaaccc

SEQ ID NO: 214574 - DNA, 677 bp, Homo sapiens
  misc_feature: GYAE6OF01CI863.1.34.D01.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcacatcacttgccgggcgagtcacggcctatcgagtcgtatttcttagccttggttgcagcaaggaaaccgnggcgacgcccctanagactacgtagtctagtggtnacatccagtagtgacgaaggtcgggtaccagtccgagttcgagtcggctagtgactagtcgtggactagtaacttacctactctacctaacgttactacgaacgacctaacggtccctacggtacgaacgtccgtaaggttaaacgttagtttttacgaacctttaaagtttttaaccttaacgtacgttaacctaaaacgttaagtttaacttaacgttaacccggttaaccccgttaagggttacgggttaacccgggtttaccgggacccgggtaaaggggggtaaaccctaaggggtaaccgggtaaaccggtaacccgtaaaaccggtaaccgttgggtaccggtacgttcggaaaccccg

SEQ ID NO: 214575 - DNA, 530 bp, Homo sapiens
  misc_feature: GYAE6OF01E00TP.1.34.D01.1.454.CMB.1.raw
  modified_base (524)..(524): a, c, t, g, unknown or other
  misc_feature (524)..(524): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagatcaccatcacttgccgggcgagtcaggccatcagcgattcttagcctggttgcagcagaaaccgagggcgacgccccctacgagtatcggtagtcgtatgggtcgctatcccagtacttgaccgaagggtcggggtccccagtcccgtaggttcaggtggcagtcgacagtcgtagggacagtattacactctctactatcagcacgcctgacagcctagaagtatttagacttaatttatactgtacaactattaatatacgtaccctagtcgacgttcggaccgagggacgtaggtcggaagtacgaacggactggcggcngtaccg

SEQ ID NO: 214576 - DNA, 403 bp, Homo sapiens
  misc_feature: GYAE6OF01B11QT.1.34.D01.1.454.CMB.1.raw
  modified_base (319)..(319): a, c, t, g, unknown or other
  misc_feature (319)..(319): n is a, c, g, or t
  modified_base (356)..(356): a, c, t, g, unknown or other
  misc_feature (356)..(356): n is a, c, g, or t
  modified_base (390)..(403): a, c, t, g, unknown or other
  misc_feature (390)..(403): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgactaattttatagtgtacaaactagtattatacgtacccctagtggacgttcggccaggggaccaaggtggaagtcaaccgactgngctgcacatctgtcttcatccttcccgcatctgaacncactcgtctgagcgggctggcaagggcacatagnnnnnnnnnnnnnn

SEQ ID NO: 214577 - DNA, 497 bp, Homo sapiens
  misc_feature: GYAE6OF01AOKRK.1.34.D01.1.454.CMB.1.raw
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcaggtggcagtgcatcgtagggacagtacttacactctacaactatacaggccagcctgcagcctagaatattttgacttaatttattactgtacaatagtattatacgtaccctagttcggacgttcgcgagggacaaggtgaatcgaacgactagcgntggac

SEQ ID NO: 214578 - DNA, 624 bp, Homo sapiens
  misc_feature: GYAE6OF01BLE29.1.34.D01.1.454.CMB.1.raw
  modified_base (276)..(276): a, c, t, g, unknown or other
  misc_feature (276)..(276): n is a, c, g, or t
  modified_base (445)..(445): a, c, t, g, unknown or other
  misc_feature (445)..(445): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttggagacagagtcaccatcacttggccgggcgagtcaggccatcagcgtatttctttagccgtggttgcagcaagaaaccgngggccgacgcccctgagtacgtcgtagtctagtggtcactataccagtacgttggacggtaaggggttccgggtacccctaacgtcccggtaaggttcgagggtcgggactaggtcgacgtacgtcggtacgggactagtacttaccgacttctactactatcacgacncgtcctgacacgtctaggtagtttatttagacttaatttacttactgttaacaattagttaattacgtaaccgttacccgtaggtacggtaccggttaccgggaccggtaacggggaacctaaggggtaacggtaaacgtaccggtaaaccggtcgttacgggtcgtccgtacggaccc

SEQ ID NO: 214579 - DNA, 704 bp, Homo sapiens
  misc_feature: GYAE6OF01C0YTJ.1.34.D01.1.454.CMB.1.raw
  modified_base (214)..(214): a, c, t, g, unknown or other
  misc_feature (214)..(214): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
  modified_base (698)..(698): a, c, t, g, unknown or other
  misc_feature (698)..(698): n is a, c, g, or t
tcagacgagtgcgtcacgaccggtgctcgatttagatcgtctgtggtttggggtttgggggagtcagaccctgtcaggacacagcatggacatggacgggtccccgctcagctccgtggggctcctgctgctctggcctcccgaggtaccagctgtgactactaccaatcgaccctagtcctccactccctccctgtctgctatctagtagganacagacgtaccaacataccgtacgttcgggaccgggagacgtacgacggccagtaccgaggtccgttaactttcgtttacgccggttgggttacgaccgaggaaccgaaacggaaacccggacggggaccgaaccggtcccccgtataacggtacgttaccggtaaggttcttaaggttcggcgactacgtccgtaaggtacgttccggaacgggtacggggttaccgggtaccctaacggtccgtaacggtcgaggtcggactacggtgacctagtcggtagggaactaagtacttaccgtactcctaanacttanacacncgtacgcgtagaccgacgtactagttaacgttattttaagaacgttttaatttacgttacctagtaactaaacgttagttaacttacgtaaccgttaccgtggtacgtacgtcggaacggtaggacgtaaggacggaacaccgtaacgtagcggtacgtcgngtaccg

SEQ ID NO: 214580 - DNA, 781 bp, Homo sapiens
  misc_feature: GYAE6OF01DXD4G.1.34.D01.1.454.CMB.1.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccactcctccctgtctgctatctattggagacagacgtccacctatccacgttcggccggcgagtcgacggccatcgagcgtattcttagtccttggtncagacgaagaaaccgngggcgaccgcccctagacgtactcggtagttcgtagtgggtgacacgtaccgaagtacgttcggaacggtaacggggtccgggtaccctagttacccggtaggtttccgaaggttcggacgtaggttcgactagtcggtacgggactaaggtaacttaccgtacttccgtaactaacttactaacgacgtaccgacgtcccgtacggaccgaacgttaccgtaaggtaaacgttttacgttttaaccgtaacttttaaaacgttttacctttaacggtaccgtttaaaccctaaagtttaaactttaaccgttttaaaccttaacccggggttaaaccccccgttttaaggggtaacccgggtttaccggggttacccgggaacccgggtaaacgggggggtaacccttaaaaggggggaaccggtaaaccggtttacccgggaaaaacccgggttaacggttacgggttaccggggtacctccgggtaaacccc

SEQ ID NO: 214581 - DNA, 461 bp, Homo sapiens
  misc_feature: GYAE6OF01D5X0X.1.34.D01.1.454.CMB.1.raw
  modified_base (415)..(416): a, c, t, g, unknown or other
  misc_feature (415)..(416): n is a, c, g, or t
  modified_base (418)..(418): a, c, t, g, unknown or other
  misc_feature (418)..(418): n is a, c, g, or t
  modified_base (420)..(429): a, c, t, g, unknown or other
  misc_feature (420)..(429): n is a, c, g, or t
  modified_base (431)..(432): a, c, t, g, unknown or other
  misc_feature (431)..(432): n is a, c, g, or t
  modified_base (434)..(461): a, c, t, g, unknown or other
  misc_feature (434)..(461): n is a, c, g, or t
tcagacgagtgcgtcacgaccggtgctcgatttagatcgtctgtgttgggtttgggagtcagggccatcagcgattctttagcctggttgcagcagaaaaccagggcgagcccctcagatcgtagtctatggtgcatccagattgcaaggtggggtcccatccaggttcagtggcagtgcatctgggacagattacactctcactatcagcagcctgcagccctagaagtattttgctaaattttattactgtacaaacagtatttatacgtacccctacggtggacgttcggccgaggggaccaagggtggaatcaacgactggtggcctgaccacgatctgtcttcattctcccgcatctagaacgactcgtctggacgcgggctgggaccaaagggtcccgactagtaacgnngntnnnnnnnnnngnngnnnnnnnnnnnnnnnnnnnnnnnnnnnn

SEQ ID NO: 214582 - DNA, 810 bp, Homo sapiens
  misc_feature: GYAE6OF01ER9TE.1.34.D01.1.454.CMB.1.raw
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccgaggtaccagctgtgacatccaattcgacccagtctccatcctccctgtctgcattctagttggagacagacgtacaccatcgacttcggccgggtgacgtcgacggccatacgagtcgtactttcgtttacgccgtggttcgcagacgaagaaaccggngggaccgaccgacccctgacggtaacgttcgtacggttactagtggtacgtacaacgttccaaggtacgtttgaaccgggtaaaggggttccgggtacccctacggttaccggtacggtttacgaacgggttcggtacgtaaggtccgacgtaacggttaccgggttaaggggaacctaacgggttaacttaacccgtaacccgtttctaaaccgtaacctttagtaaccgaccggaccgtaaccgtcccggtacgaccgtacggtacccttaaggttaaacgtttcttttaacgaactttaaatttttaaccgtaacttaaccggttaactaaacgttaacgtttaacgttaaccgtttaacccggttaacccgggttacggtttaaccgggaacccggttttcccgggggaaaccggaacggggggttaaaccgaaagggggttaaccggaaaaccgggttccccgtaaaaacgggttacgttaggtaccggggtactcggttaaaccccg

SEQ ID NO: 214583 - DNA, 590 bp, Homo sapiens
  misc_feature: GYAE6OF01BK8AU.1.34.D01.1.454.CMB.1.raw
  modified_base (323)..(323): a, c, t, g, unknown or other
  misc_feature (323)..(323): n is a, c, g, or t
  modified_base (393)..(393): a, c, t, g, unknown or other
  misc_feature (393)..(393): n is a, c, g, or t
  modified_base (577)..(577): a, c, t, g, unknown or other
  misc_feature (577)..(577): n is a, c, g, or t
tcagacgagtgcgtcacgaccggtgctcgatttagatcgtctgtgttgggtttgggggagtcagaccctgtcaggacacagaatggacgatgagggtccccggccctcacgcgtccctcgggggcggtcccttcggctcgctccttggcgtccccacgggtaccgacgcgtgtggacaatcctaacttagtacccacgtctcccactcctcccctcgtctgcatctattggaggacagagtcaccatcacttgccgggcgagtcaggccactcagcgattcttttagcctcggtttggcagcacgaaaaccgacgggcggacncccctccaggatcgtaggtctatggtgcatccagattgcaaagggtgggggtcccatccgaggttcgagnggcgagtgcatcgtgggacagattaccactctcactattcagcacgcctgcacgacctcgaagtattttcgtactaattttactttaacctggtactaactaggttattaattacgtacccctacggtggtaccggtcggacgacggggtacaagggtcggaggttacaaccggtacgttcggnggctgcctacccg

SEQ ID NO: 214584 - DNA, 788 bp, Homo sapiens
  misc_feature: GYAE6OF01A0INS.1.34.D01.1.454.CMB.1.raw
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
tcagacgagtgcgtcacgaccggtgctcgatttagatcgtctgtggttgggtttggggagtcagaccctgtcaggacacagcatggtacatgagggtccccgctcagctcctggggctcctgctgctctggctcccgaggtaccagctggtcgacattccgaattcgaccctagtcctccatccctcccgtggtcctggcattccgtagttcggagtacctaggacgtccaaccgagtcgaccttggcccgggtctaacgtcgacggcctatcgaacgccgtattccgtttaggccgtggttcgccgaggccaaggtaaacccgnggggccaccgtcccctagacgtactacgtaagttcgtagtcggtcncgtactaccgtacgtagtacggacggtaacggggtcgggtaccgtacgtacgtacgggttacacggttcggacgtacgtcgacgtaccgttacgtacggggaacctacggtaacttaaccgtaacttacctaacgtaaccttaacgtacggaacgtacccgtacggtcccgttacgggaccacgttacgtaggtaaacggtttaccgttttagaaccttaaagtttttaactaccgttagttaacccgtaaattaaccggttattttaacccgtaaccggttaaccccgttttacgggtacgggttaacccggtttccggggaacccggtaagggggttaaccggtaaaccgggttaagggtaaaccgttacccggtaaacgtaacgggttggtacgggtacccctgggtaaacccc

SEQ ID NO: 214585 - DNA, 658 bp, Homo sapiens
  misc_feature: GYAE6OF01A9K26.1.34.D01.1.454.CMB.1.raw
  modified_base (103)..(103): a, c, t, g, unknown or other
  misc_feature (103)..(103): n is a, c, g, or t
  modified_base (196)..(196): a, c, t, g, unknown or other
  misc_feature (196)..(196): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
tcagacgagtgcgtcacgaccggtgctcgatttagatcgtctgtgttgggtttgggggagtcagaccctgtcaggacacagcatggacatggagggtccccgntcagctcctgggctcctgctgctctggctcccaggtaccagctgtgacatccaattgacccagtctccatccctcctgtctgcatctatgganacagatcaccatcacgttggccgggcgagtcaggccatccagcgtatttctttagccttggttagcagcaagaaccgngggcacgcccctnagtntcgtagtctagtggtnctatccagtattgcgtaacgggtcgggtacctagtccgaggttcaggtcggnagtgctaagtccgtaggacaggtacttacgacttctacacgttatcgaacgtcgaacgtccgtgacctacggtacctaaggttaaagttaacgtttttcaaaccgttttaaagtttttctttaaccgtacgggttaaccctaaacgttaagtttaaccgtttaacgttaacccggttaaccccggtttacgggttaccgggttaaacccgggttccgggaacccgttaagggggaacccttaaggggtaccggtaaacgtacccgaaaccggtacttagggtcggtacgtcggtaaccc

SEQ ID NO: 214586 - DNA, 564 bp, Homo sapiens
  misc_feature: GYAE6OF01D3M12.1.34.D01.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (408)..(408): a, c, t, g, unknown or other
  misc_feature (408)..(408): n is a, c, g, or t
  modified_base (544)..(544): a, c, t, g, unknown or other
  misc_feature (544)..(544): n is a, c, g, or t
  modified_base (560)..(560): a, c, t, g, unknown or other
  misc_feature (560)..(560): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttggccgggnagtcaggccatccagcgtatttcttagcctggttgcagcagaaaccgngggccgacgcccctnaggactcgtagtctagtggtgcatccgagtatcgacgaaggggtcggtacccagtccgtaggttcaggtggctaggtcacgtacgtcgtagggactagtacttactacctctacaaccttacncgaacgcgacgcctagaccacgtacctaggtaaatttcttttacgactttaattttacttacgtcgttaacaaacgttgttaacttacgtaccgtacccttagtcggtacgtcggacggagggactagggagtaanacgtaacgagtgtgcngacc

SEQ ID NO: 214587 - DNA, 612 bp, Homo sapiens
  misc_feature: GYAE6OF01BOI30.1.34.D01.1.454.CMB.1.raw
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
  modified_base (391)..(391): a, c, t, g, unknown or other
  misc_feature (391)..(391): n is a, c, g, or t
  modified_base (594)..(594): a, c, t, g, unknown or other
  misc_feature (594)..(594): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcctcctgctgctcgtggcctcccaggtaccagctgtgacatccaattcgacccagtcctccatccctccctgtctgcatctatggagacagagtcaccatcacgttcgccggngagtcgacgcatcgagcgtattcgttacgccgtggtgcagcgaaaggaaaccgngggaccacgcccctagagtactcggtagtctagtggtcacacgtacgagtacgttcggacgtaaggggtccggtccctaagtcccgtaaggttcagggtgactaggtnacgtagtcggtaggactaggtacttacaccttacgtactaactacgtacgacgccgacgcgtcgaccgtacgtacctaggtaacgtttagtttgaactttaagtttactacgtagtacctaagttacgttatacgtaccgtaccgtaggtacggtaccgtcggacggtacggaaccgtaaggtaccggaactacgtaaaccgngttggacgtcgtacgacg

SEQ ID NO: 214588 - DNA, 637 bp, Homo sapiens
  misc_feature: GYAE6OF01AW4C9.1.34.D01.1.454.CMB.1.raw
  modified_base (131)..(131): a, c, t, g, unknown or other
  misc_feature (131)..(131): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagacgagtgcgtcacgaccggtgctcgatttagatcgtctgtgttgggtttgggggtaggtcgagaccctgtcaggacacagcatggacatgagggtccccgcgtcagctcctggggctcctgctgctntggctccaggtaccagctgtgacatccaattgacccagtctccatcctccctgtctgcatctatgganacanagtcaccatcacttgccgggctagtcaggccatcagcgtattcttagtcctggttcgctagacaagaaccgtagggcgacgcccctanagatcgacgtctagtgtcgtacatccagtattgaccgtaagggtccgggttccaagtccgtaggttacaggttcgggcaggtacgctacgtcggtagggaacaggtaactttacaacgttcgtcaacttagtcgaacgtactacgacccgtagccttacggaccttacggtaacgttaagttttccggaattaactttttaacgtacgttacggtacctaaagtactttaacttaacgtaccgtaacccgttagtccggtaacggtttaccggacggaacggttaaccgggaaattaccgggtaaataccgtaaaccggttacggaagttccgggtacgcggtaac

SEQ ID NO: 214589 - DNA, 408 bp, Homo sapiens
  misc_feature: GYAE6OF01BA0SQ.1.34.D01.1.454.CMB.1.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (404)..(408): a, c, t, g, unknown or other
  misc_feature (404)..(408): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacaactagttattaatacgttaccccctaggtggtacgttcggccagggggaccaaggtggaacgtcgaaccggaactggtcggctgaccacctatctgtccttcactcttcccgctatcngaacncactcgtngngcggctggcaggcanatgnnnnn

SEQ ID NO: 214590 - DNA, 584 bp, Homo sapiens
  misc_feature: GYAE6OF01A5QYQ.1.34.D01.1.454.CMB.1.raw
  modified_base (284)..(284): a, c, t, g, unknown or other
  misc_feature (284)..(284): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaggaaaccagggcgacgacccctnagatccgtagtctagtggtgcatcagtattgacaagggtcgggtcccagtcccgaggttccaggtggcagtgcatcgtagggacagtacttacacgttcactactaatcagcacgcctgctacgctagaagttntttcgacttaattttaatactagtactaaactagttaacttaacgttaccgtaaccccgttaggtacggtacccggtttacgggacccggtaacgggggaacccggtaaggggtacggtaaacggtaaccgtaaccggtaacgttgggtacggtccgtacggtacc

SEQ ID NO: 214591 - DNA, 651 bp, Homo sapiens
  misc_feature: GYAE6OF01DQ2AC.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattgacccagtctccatcctccctgtctgcatctatggagacagagtcacatcacgttcgccgggcgagtcgaggccatcagtcgtatttcttagccgttggttcgcagacaagaaccgagggccgaacgcccctagagtacttccggtagtcgtagtggtcgactatccgagtattgacgtaacggggttcggtccaacgtccgaaggttcaggtcggacgtaggtcgacgtaagtcggtagggaacagtacttacacttccactactagtcgacgtcacgtccgtagaccacgtaccttaggtaaactttagtttacgtaactttaagtttttaactaacgttacgttaacttaaacgtagttttaaccttaacgttacccgttaacccgttaggtaccgggttaaccggttaccggaccgggtaacggggtaacgtaaggggtaacgaaaccgttaacggaaaccggttacgtggtcggcgtacgtacccg

SEQ ID NO: 214592 - DNA, 609 bp, Homo sapiens
  misc_feature: GYAE6OF01A4XW5.1.34.D01.1.454.CMB.1.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacgttcgccgggcgagtcaggccatcagcgtattctttagccttggttgcagcaagaaaccgngggccgacgccccctanagtactcgtagtctagttgggtcncatccagtattggacgtaaggggtcgggtacccagtccgtaggttcgaggtggactaggtcgactagtcgaggggactagtaacttaccacttctacaacgttatacaagccacggtcctggacacgtcctagtaagttatttgaacttaaattttatactagtactaaacgtattaacttacgtaccgtaccccgttaggtacgggtaccggttacggaccgggtaaggggaacctaacggggttagaaaacggtccctaaaaccgggtacgtggtaggtccgtggtaaccc

SEQ ID NO: 214593 - DNA, 727 bp, Homo sapiens
  misc_feature: GYAE6OF01BRNCF.1.34.D01.1.454.CMB.1.raw
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (448)..(448): a, c, t, g, unknown or other
  misc_feature (448)..(448): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgatttctttagccttggttgcagcaacgaaaccngggccacgcccctnacgatcgtagtctatggtcgctatccgagtatttcggacggtaaacggggttcggggtacccctagttccccgtaagggtttccgaaggttcgggactaggtcgacgtagtcggtacggggaactaaggtactttacctaacgttccttacaaccgtttanctaacggcctaaccggccctcggacctaacggtcccgttaagtaaacgtttactttttacggtaaccttaagttttttacgtttaactttacggttaacctaaaccttaaggttttaacttaaccgttaacccgttaaacccccgtttacgggttaccgggttaaccccgggtttaccggggaacccgggtaacgggggtaaaccgtaaacgggggtaacggtaaaccggttaaccgaaaacccgggttaacgttgggtacggtcccgtagtaaccccg

SEQ ID NO: 214594 - DNA, 674 bp, Homo sapiens
  misc_feature: GYAE6OF01DQXL3.1.34.D01.1.454.CMB.1.raw
tcagacgagtgcgtcacgaccggtgctcgatttagatcgtctgtgttgggtttgggggagtcagaccctgtcaggacacagcatggacatggagggtcccccgctcagctccgtggggcctccctgctgctctggctcccaggtaccagctgtgacatccaattcgacccagtctccactcctccctgtctgcatctagtggagacagacgtcaccatcacttcggccgggcgaggtcacggccatcagtacgtattcttacgccttggttcgcagacaacggaaaccgaggggccgaccgaccccctacgagacgttcggtagtactagtgggtcacgtactaccgagtagtcggacggaaggggttccgggtaccccagttccgaggtttcgaggttcggacgtagtggactaggtccggtagggaactaggtaacttaccaccttctacactatcgagtacaccgtcctggaccacgtccgtaagtaagtttacttttacgtaatttaacttttaacgttaccttagtaacgttaaacttagtttaacttacgttaacccgttacccgtaggtaccggttaccggttacgggacccggtaaggggacgtaaacgggtaacggtaaccgtaaccggaaaccggttaacgttggtaccggccgtacgtacccg

SEQ ID NO: 214595 - DNA, 686 bp, Homo sapiens
  misc_feature: GYAE6OF01BAGXS.1.34.D01.1.454.CMB.1.raw
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcataccctgtcaggacacagcatggacatgagggtccccgctcagctccgtggggctcctgctgctctggctcccaggtaccagctgtgacatccaattgacccagtctccatccctcctgtctgcatctattggagacagagtcaccatcacgttggccgggacgagtcacggccatcagcgtattctttagcctggttnacagacgaacgaaaccgaggggcgacgcccctanagatcgtagtctagtggtacactactccgagtacgttacggacgtaacggggtcgggtacccaagtccgtagggttcgagggtcgacgtaggtcgacctagtacggtagggaactaacggtaactttaccgacttcctactaacttacgtacgacgtactaacgccgttcgactacggtacttaggtaaatttctttagactttaaatttacttacgttaacgtaaccttaaacgttagtttaacgttaaccgttaacccggtaacccggttaccggttacggggttaacccggttaccggacccgggttaagggggaacccgtaaagggtaccgggtaaaccgtaccgtaaaccggtaacggttacgggtcggtaacgtcggtaacccg

SEQ ID NO: 214596 - DNA, 691 bp, Homo sapiens
  misc_feature: GYAE6OF01DBWMO.1.34.D01.1.454.CMB.1.raw
tcagacgagtgcgtcacgaccggtgctcgatttagatcgtctgtgttgggtttgggggagtcagaccctgtaaggacacagcatggacatgagggtccccgctcagctcctggggctcctgctgctctggctcccaggtaccagctgtgacatccaattgacccagtctccatcctcctgtctgcatctatggagacagagtcaccatcacttgccgggcgagtcaggccatcagcgtattctttagcctggttgcagacaagaaaccagggcgacgcccctacgagatcgtagtctagtggtgcatccagtacttggacgtaagggtcggggtccccaagtcccgtagggttccagggtggaccaggtcgcgtagtcgtaggggacaaggtattaaccaccttcctacgtactactcacggtcaacgccctgaccacggtccctaggtaacgtttacttttgaacctttaaagtttttacttaacttacggttaacctaaacgttaacgtttaactttaaccgttaacccggtttaacccccgttaacgggttacgggtaaacccggtttcccggggaacccggtaaacggggggtaacccctaaagggggtttaacggaaaaccggttaccccgtaaaaaccggtaaccgtttagggtacgggtacccgttcggtaacccgtaaacccg

SEQ ID NO: 214597 - DNA, 593 bp, Homo sapiens
  misc_feature: GYAE6OF01BC1UF.1.34.D01.1.454.CMB.1.raw
  modified_base (385)..(385): a, c, t, g, unknown or other
  misc_feature (385)..(385): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggcgagtcaggccatcagcgtattctttagcctggttgcagcagaaaccgagggcgacgcccctcagatcgtagtctatggtgcatccagattgcgaaggtcgggtcccatccgaggttcaggtggcgagtgcatcgtgggacagattacgactctacacttancaagtcagcctgccagcctgaagttatttcgtacttaaattttacttaacgtcgtaactaacttaagttaacttaacgttaaccgttaccccgttaacggttcgggtaacccggttaccgggaccggtaacgggggaacccttaaagggggtacggtaaacggttacccgaaacccggtaacgttaggacgggtcgtcggtaaccccg

SEQ ID NO: 214598 - DNA, 546 bp, Homo sapiens
  misc_feature: GYAE6OF01EQWT5.1.34.D01.1.454.CMB.1.raw
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (366)..(366): a, c, t, g, unknown or other
  misc_feature (366)..(366): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttncagcaagaaaccgagggcgacgcccctnagatcgtagtctagtggtgcatccagtagttgacgtaagggtcgggtcccagtcccgaggttcaggtcggcagtgcagtcgngggacagattaccactctcactatcagcacgcctgcacgtcctagaagttatttgacttaatttatacgtgtacaacgttagttaattacgtaccgtaccccgttaggtcggtacgttccggaccgagggaacctaagggtcggaaacgtaccgaaccggtactggtcggtctgtacccg

SEQ ID NO: 214599 - DNA, 544 bp, Homo sapiens
  misc_feature: GYAE6OF01A19WP.1.34.D01.1.454.CMB.1.raw
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcagaaaccagggcgacgcccctcagactcgtagtctatggtgcatccagnttgacgtaagggtcgggtcccatccgaggttcaggtggcagtgcatcgngggacagtacttacactctcactatcagcagcctgcagtcctagaagttntttacgattaattttacttacgtgtacctaactagttaattactaccgttacccctaggttcggaccggtttcgggacccgtaggggaacctaagggtacggaaactaccgaacggtaactggtcggcgtgaccc

SEQ ID NO: 214600 - DNA, 600 bp, Homo sapiens
  misc_feature: GYAE6OF01D8ZK1.1.34.D01.1.454.CMB.1.raw
  modified_base (282)..(282): a, c, t, g, unknown or other
  misc_feature (282)..(282): n is a, c, g, or t
  modified_base (318)..(318): a, c, t, g, unknown or other
  misc_feature (318)..(318): n is a, c, g, or t
  modified_base (369)..(369): a, c, t, g, unknown or other
  misc_feature (369)..(369): n is a, c, g, or t
  modified_base (399)..(400): a, c, t, g, unknown or other
  misc_feature (399)..(400): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttggggtttgggggagtcagaccctgtcaggacacagcatggacatgagggtccccgatcagctcctggggctcctgctgctctggctcccaggtaccagctgtgacatccaattgacccagtctccatcctccctgtctgcatctattggagacagacgtcaccatcctacgttcggccggggcgagtcaggccatcagtcgattctttagccttgggttgcagacaagaaaccgngggccgacgcccctgagatcgtagtctaagtggtcncatccagagttgacgaagggtcgggtcccagtccaggttcaggtggcagtnctatcgagggacagtatacactctcactannagacacnccgtgacacgcctagtaagtattttgacttaaatttaacttacgtcgtaactaacgtagttaattaacgttaaccgtaaccccttagggtacggtaacgggttccggaccggtaaggggaacccgtaaaggggtacggaaaccggttaacccgtaaaaccggtaacgttagggtacggtaccgttgaaacccg

SEQ ID NO: 214601 - DNA, 593 bp, Homo sapiens
  misc_feature: GYAE6OF01EUXYW.1.34.D01.1.454.CMB.1.raw
  modified_base (196)..(196): a, c, t, g, unknown or other
  misc_feature (196)..(196): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (423)..(423): a, c, t, g, unknown or other
  misc_feature (423)..(423): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatgganacagatcaccatcacttgccggcgagtcaggccatcagcgattcttagcctggttgcagcaagaaaccgngggcgacgcccctanagactcgtagtctagtggtgcatccagtacttgcgtaaggggtcgggtacccagtccgaggttcgaggtcggctagtcgctatcgtagggacagtacttacacctctcactatcacgcacgcctgcagtcctagtaacgttntttacggacttaagttttacttacgtcgttaactaacgttaagttacctttaatacccggttaccccgttaacgggtcggtaccggttccggaaccgggtaaggggtaacccgtaagggtacgggtaaacgtaccgtaaaccggtacgtacggtcggtccgtggtaaccc

SEQ ID NO: 214602 - DNA, 574 bp, Homo sapiens
  misc_feature: GYAE6OF01BW9A9.1.34.D01.1.454.CMB.1.raw
  modified_base (282)..(282): a, c, t, g, unknown or other
  misc_feature (282)..(282): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatggagacagagtcaccatcacttggccgggcgagtcaggccatcagcgtattctttagcctggttgcagcagaaaccagggcgacgcccctnagatcgtagtctatggtgcatccagattgacgaagggtcgggtcccagtccgaggttcaggtggcagtgctatcgtagggacagtattacacttctcactatacagcagtcctcgcacgtaccgtgaacgttnttttacgacttaaatttttactaaccgttagtacctaagtaacgttattaacgtaaccgttacccctagggttcgtaaccggtttccgggaccgtaagggggtacccgtaagggtacggaaacgtaccgaaacccgtaagtaggtcggtcgtgaacccg

SEQ ID NO: 214603 - DNA, 563 bp, Homo sapiens
  misc_feature: GYAE6OF01BDYD0.1.34.D01.1.454.CMB.1.raw
  modified_base (284)..(284): a, c, t, g, unknown or other
  misc_feature (284)..(284): n is a, c, g, or t
  modified_base (384)..(384): a, c, t, g, unknown or other
  misc_feature (384)..(384): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttgccgggcagtcaggccatcagcgtattcttagcctggttgcagcagaaaccgagggccgacgcccctnagactcgtagtctagtggtgcatccagtattgacgaagggtcgggtacccagtcccgtaggttcaggtggcagtgcatcgtgggacagtattacacttcnctactatcagcacgtccctgcagtcctaggaacgttatttacgacttaattttacttacttgtaactaactaagttaattacgtacgttaccccgtaggttcggtaccgttacggacccgtaggggaaccctagggtacggaacgtaccgtaaaccggtacgtaggtcggacgtgaccg

SEQ ID NO: 214604 - DNA, 397 bp, Homo sapiens
  misc_feature: GYAE6OF01E12JG.1.34.D01.1.454.CMB.1.raw
  modified_base (317)..(317): a, c, t, g, unknown or other
  misc_feature (317)..(317): n is a, c, g, or t
  modified_base (379)..(379): a, c, t, g, unknown or other
  misc_feature (379)..(379): n is a, c, g, or t
  modified_base (384)..(397): a, c, t, g, unknown or other
  misc_feature (384)..(397): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgagtattttgctaatttatactgtcaacagttattatacgtacccctagtggacgttcggccaggggaccaagtgaatcaaccgatgtgctgcacntctgtcttcattcctcccaccctctcaccgcactcgtctgacgtcgggctgggacaaggccnatagnnnnnnnnnnnnnn

SEQ ID NO: 214605 - DNA, 589 bp, Homo sapiens
  misc_feature: GYAE6OF01CSINM.1.34.D01.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (375)..(375): a, c, t, g, unknown or other
  misc_feature (375)..(375): n is a, c, g, or t
  modified_base (529)..(529): a, c, t, g, unknown or other
  misc_feature (529)..(529): n is a, c, g, or t
  modified_base (573)..(573): a, c, t, g, unknown or other
  misc_feature (573)..(573): n is a, c, g, or t
tcagacgagtgcgtcacgaccggtgctcgatttagatcgtctgtgttgggtttggacatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttncagcaagaaaccgngggccgacgcccctagagatcgtagtctagtggtcgcatccagattgcgtaagggtcgggtcccagtcccgtaggttcgaggtcggctaggtcgcgtatcgtagggactagtacttacactctacactnacacgcagcctgcacgccgtaagaacgtttatttcgactttaatttatactagtaacaatagtttaattaaccgtaccgttacccgtaggttcggtaaccggttccgggaaccggtacgggaacctaggggtacgtaacgtaccgaaaccggtntagggtcgtacctacggtaccaccgtattccgtcgtttactacnccttcccgtcctaccg

SEQ ID NO: 214606 - DNA, 493 bp, Homo sapiens
  misc_feature: GYAE6OF01D4CJ4.1.34.D01.1.454.CMB.1.raw
  modified_base (222)..(222): a, c, t, g, unknown or other
  misc_feature (222)..(222): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcaagaaaccagggcagcccctcagatcgtagtctatggtgcatccagattgcaagggtcgggtcccatccaggttcagtggcagtgcatcgngggacagattacactctcactancagcagcctgcagcctagaagtntttgactaattttatactgtacaactagtattactacgtacccctagtcggacgttcggcgagggaccaggtggaatcgaacgactgngntgaccg

SEQ ID NO: 214607 - DNA, 595 bp, Homo sapiens
  misc_feature: GYAE6OF01D73UY.1.34.D01.1.454.CMB.1.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggngagtcaggccatcagcgtattcttagcctggttacagacaagaaaccngggccacgcccctnagatcgtagtctagtggtcgctatccagtactttgacgtaagggtcgggtacccagtcccagggttcagtggacagtgacagtcgagggactaggtaacttacgcttctactaactatacgacgacacgtcctagaccagtcctaaggtaagttacgttttagacctttaattttaacttacgttcgtaaccgtaaacgtaagttaactttaacgtacccgtaacccgttaggttacggtaccggttcgggaccgtaggggaaccttaagggacggtaaactcgaaaccgtgtacggcgactcgactaccg

SEQ ID NO: 214608 - DNA, 749 bp, Homo sapiens
  misc_feature: GYAE6OF01A1Y88.1.34.D01.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcacatcacttgccgggcgagtcaggccatcagcgtattctttagcctggttncagcaagaaccgngggcgacgcccctnagactcgtagtctagtggtagcatccagtattgacgtaaggggtcgggtaccagtccgtaggttcaggtcggacgtagtcgacgtagtcggtagggaactaaggtaactttaccaccttacgtacctaactttacgaccgacgacctacggtcccttcggaccgaacggtacccgttaaggtaaacgttttaacgtttttacggtaaacttttaactttttaacgtttaccgttacgttaaaccgtaaacgtttaagttttaaactttaaccggttaaaccccggttaacccccggtttaacgggttaccggggtttaaaccccgggttccggggtaaccccgggtaaacgggggggttaaaccccgttaaaggggggttaacccgggtaaaacccgggttaaaccccggtaaaacccggttaacgggtttagggttacccgggttaaccgtccggtaaacccccgg

SEQ ID NO: 214609 - DNA, 583 bp, Homo sapiens
  misc_feature: GYAE6OF01BBZW9.1.34.D01.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttcggccgggcgagtcaggccatcagcgtatttctttagccgttggttcgacagacaagaaaccgngggcgacgcccctagagtacgtcgtagtctagtggtncatccagtagtgacgtagggtcggtccagtccgtaggttcaggtcgacgagtcgactagtcgtagggactagtactacactcactactncagcagcctgcacgtcgtaagtaagttactttagactttaaattttacgtactagtacctaactagtttaacttacgttaccgtacccgttaggtcggtaaccggttccggacggtaagggacccgtaagggtacggaaagttaccccgaaacggtacggttggacggtctggacccg

SEQ ID NO: 214610 - DNA, 501 bp, Homo sapiens
  misc_feature: GYAE6OF01BJHT4.1.34.D01.1.454.CMB.1.raw
  modified_base (390)..(390): a, c, t, g, unknown or other
  misc_feature (390)..(390): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggtgcagcagaaaccagggcgagcccctcagatcgtagtctatggtgcatccagattgcaaggtgggtccatccaggttcagtggcagtgcatctgggacagattacactctcactatcagcagcctgcagcctgaacgtnttttagctaattttaatactgtacaaactattaattataacgtacccctagtggacgttcggccgtaggggaccgaagggtaggaacgtcgaaaccgactgtcggctgacc

SEQ ID NO: 214611 - DNA, 709 bp, Homo sapiens
  misc_feature: GYAE6OF01BAJUC.1.34.D01.1.454.CMB.1.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcattctagttggagacagagtcacctatcctacgttcggccgggcgagtcacggccatcgagcgtattcttagcctggtcncagacaacgaaccgngggcacgcccctnacgtatcgtagtctagtggtgctacgtcagtnttcggacggtacggggtcgggtacccaacgttccgtaaggttcgagggtcggtcgaggtcgacgtacggtcgtagggacctaaggttaacttaaccgtaccttactacgtaacttacgtaccgaacgtccgtacggtcccgttacggacccgtaacggttacccgtaaggtaaacgttttacgttttacggtaacttttaaacgtttttaacgttacgttaacggtaaccttaaacgtttaagtttaaccttaacgttaacccggtacccgttagggttaccgggttaaccggtacccggggaacggtaaccggggtaacggtaacgggtacgggtaaaccgaccgtaaaccggtaggtaccggtgtaccgtacgtaccc

SEQ ID NO: 214612 - DNA, 710 bp, Homo sapiens
  misc_feature: GYAE6OF01BGFI5.1.34.D01.1.454.CMB.1.raw
  modified_base (298)..(298): a, c, t, g, unknown or other
  misc_feature (298)..(298): n is a, c, g, or t
  modified_base (497)..(497): a, c, t, g, unknown or other
  misc_feature (497)..(497): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattcgacccagtctccacttccctcctgtctgactatctagtggagtacagacgtccacctatccacgttcggccgggcgagtcgacggccagtcagcgtatttcttagccgttgtgcagacagaaccgcgggcacgcccctnagtactacgtagtctagtcggtgctactccgtagtagttcggacggtaacggggtccgggtaccctaagtcccggtaggttccgaagggttcggacgtaggtcgtaccgtagttaccgggtacgggtaacgtacggttaacctttaaccggtaccctttctacccgttaaactagtccgtaacgcccgaagttacccgngtacctacggtaccgttacggtaatttcgttacgtactttaatttaccttacgtaccgttataaacgttagtttaaccttagttaacccgttaccgtacgggttccgggttaacccgtccggggtaacgtaccgggtaaccggacgggttaagaaacccgtttacccggtaaaccgtacggtttacgggtacggtacccgtcggttaaacccg

SEQ ID NO: 214613 - DNA, 624 bp, Homo sapiens
  misc_feature: GYAE6OF01BKHV2.1.34.D01.1.454.CMB.1.raw
  modified_base (221)..(221): a, c, t, g, unknown or other
  misc_feature (221)..(221): n is a, c, g, or t
  modified_base (284)..(284): a, c, t, g, unknown or other
  misc_feature (284)..(284): n is a, c, g, or t
  modified_base (617)..(617): a, c, t, g, unknown or other
  misc_feature (617)..(617): n is a, c, g, or t
tcagacgagtgcgtcacgaccggtgctcgatttagatcgtctgtgttggatttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggnagtcaggccatcagcgtattcttagccttggtgcagcaagaaaccgagggccgaacgcccctnaggtactcggtagtctagtcgggtcacataccaggtaattcggacgtaaacgggtcggggtacccaagttccgaggtttcgaggttggactagggttcacgtaacgtcggtaggggaacaacggtatttaccactttccataacctagtaccgaagtcaacgtccttagaccgtacggtaccctaggtaacttacgttttacgaactttaattttaacgtacttcgtaacctaactagttacttaacgtaccgtacccgttaggtacggtaccggttcgggacgacgggtaaccgaagggtacggaaacgtccgaaaccgtagtgggtaccgngtaaccg

SEQ ID NO: 214614 - DNA, 799 bp, Homo sapiens
  misc_feature: GYAE6OF01B6WHX.1.34.D01.1.454.CMB.1.raw
  modified_base (199)..(199): a, c, t, g, unknown or other
  misc_feature (199)..(199): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctatgganacagatcaccatcacgttcggccgggcgagtcgacggccatcagcgtatttctttacgccttggtgcagcaacgaaaccgngggcgacgcccctnagatcgtagtctagtggncatccgagtagtgacgaaggggtcgggtccacgtccgtaggttcagggtcggacgtaggtcgactacgttcggtagggacaaggttaacttacccgaccttcctaccgtaaacttacgtaccgaacggacctaaccggtcccgtaggacccgaaccggtcccgtaagggttaaaccgttttagtttttaacggtaacttttaaaacgttttttaacgtttaacccggttacggttaaacccttaaaaggttaacgtttttaaaccgttttaaccgtttaaaccccgggtttaaaccccccggtttaacgggttacccgggggttaacccggtttaccccgggggaaacccgggggtaaaaccgggggggttaaaacccgggttaaaacgggggttaaccgggttaaaaacccgggttaaacccccgtaaaaacccgggttaaccggttagggttaacccgggttaacccggtaccggtaaacccccg

SEQ ID NO: 214615 - DNA, 621 bp, Homo sapiens
  misc_feature: GYAE6OF01CTTQA.1.34.D01.1.454.CMB.1.raw
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaccatcacgttggccgggcgagtcaggccatcgagcgtacttctttacgccttggttgcgagccgaacgaaaaccgngggccgacgccccctcgaagtntcgtagtctagtggtcgcatccgagtacttggacgtaagggtcgggtaccccagtcccgtaggttacaggtcgggacgtacgtggtactagttcgtacgggaactagtaacttacaactctacactatcagtaccacgtcctgccgacgtccgtaagtaagttactttttacgaactttaaagttttacttaaccgttagtactaacgttaagttaacttcgtaaccgttaccccgttaggtcggtaaccgttccgggaccgaaggggaaccgtaaggtcgggtaactaccggaacgacgttggcgtcgtcgaccg

SEQ ID NO: 214616 - DNA, 388 bp, Homo sapiens
  misc_feature: GYAE6OF01AJNRA.1.34.D01.1.454.CMB.1.raw
  modified_base (381)..(381): a, c, t, g, unknown or other
  misc_feature (381)..(381): n is a, c, g, or t
  modified_base (384)..(388): a, c, t, g, unknown or other
  misc_feature (384)..(388): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaaggtggggtcccatccaggttcagtggcagtgcatctgggacagattacactctcactatcagcagcctgcagcctgaagtattttgctaattttattactgtacaacagtattatacgtacccctagtggacgttcgccaggggaccaaggtggaagtcaaccgaactgtggctgcacatctgtcttcatccttcccgacctcctcacgcactcgtctgagcgggctggcaaggcnatnnnnn

SEQ ID NO: 214617 - DNA, 645 bp, Homo sapiens
  misc_feature: GYAE6OF01E26CU.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctattggagacagagtcaccatcacgttggccggcgagtcacggccatcgagcgtactttcgtttacgccttggttgcagacgaaggaaaccgagggccgacgccccctacgagacgtcgtagtctagtggtgctacgtccagtacgttggacgtaagggtcggtacccaagtccgtaggttcgaaggtggacgagtcgactagtcgtagggaactagtaacttaaccacttcctactaactataccacggtacctacggtcccgtcgaccgtacggtaccgttaggtaaacgtttcttttacgaacctttaaagtttttaacgttaccgttacgtaacctaacgttagttaattacgttaaccgtaccccgttaggtacggtaccgttacgggaccgtagggtaaccgtaagggtacgtaacgtacgtaaaccggtacgttaggtcggacgtgacccg

SEQ ID NO: 214618 - DNA, 703 bp, Homo sapiens
  misc_feature: GYAE6OF01AG23Q.1.34.D01.1.454.CMB.1.raw
  modified_base (269)..(269): a, c, t, g, unknown or other
  misc_feature (269)..(269): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacataccaattcgacccagtctccactccctccctgtctgcatctagtggagacagagtcaccatccacgttcggccgggcgacgtcgacggccatcagcgtatttcttagcctgggttncagacgaacggaaccgagggccaccgcccctagagactcgtagtcgtagtcggtcactactaccgtagtagttacggacggtaacggggtccgggtaccctagtaccgtaggttcgaggtcggacgtaggtcgtacgtacggtcgtagggaactaggttacttaacctaccttactacctaacttcgtaacacggtacccgtacgcccgttagaccgtaccggtacttaaggtaacgttttaacttttcggaacttttaacgttttactaaccgttacgttaaacctaacgttaagtttaccttaacgttaacccgggttaacccgtcgggtttaaccggtacccggtttaccggaccgggttaacggggtaacggtacggggtaacgtaaccgtaccggtaaaccggtacggtacgtcggtcctacgtacccg

SEQ ID NO: 214619 - DNA, 557 bp, Homo sapiens
  misc_feature: GYAE6OF01AKOWQ.1.34.D01.1.454.CMB.1.raw
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (313)..(313): a, c, t, g, unknown or other
  misc_feature (313)..(313): n is a, c, g, or t
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagagtcaccatcacttggccgggcgagtcaggccatcagcgtattctttagcctggttncagcagaaaccgagggcacgcccctnagatcgtagtctagtggtncatccagtnttggacgtaaggggtcgggtacccagtccgaggttcaggtcggcaggtacgaattcgtagggactacgtattaccactctactaactatcacgcacgcctgacacgtcctagaagttntttacgaactttaattttntaacgttntaactaatagttactttactaccgtacccgtaggtcggtaccgttcgggacgacgggtacgaggtacgacgtacgaacgtacgtggagcgtcgctaccg

SEQ ID NO: 214620 - DNA, 626 bp, Homo sapiens
  misc_feature: GYAE6OF01DUBZW.1.34.D01.1.454.CMB.1.raw
  modified_base (197)..(197): a, c, t, g, unknown or other
  misc_feature (197)..(197): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcacatcacttgccggcagtcaggccatcagcgtatttctttagcctggttgcagcaagaaaccgagggccgacgcccctgagtactcgtagtctagtggtcgcactccagtattggacgtaacgggtgggtacccagtccgtaaggttcaggtggctagtcgtacngtcgtaggactagtacttacacttctactactancgaagcacgtcgtgaccacgccgttagaagtttatttcgtaaccttaagtttttactacgttacgtactaaacgtagtttaacttacgttaaccgttaaccccgttacgggtacggttaaccggttaccgggtaccggtaacggggggtaaccttaaggggtacgggtaaaccgtaaccgtaaacccggtaacggttacggtagggtaccttcggaaacccg

SEQ ID NO: 214621 - DNA, 759 bp, Homo sapiens
  misc_feature: GYAE6OF01D3FQJ.1.34.D01.1.454.CMB.1.raw
  modified_base (102)..(102): a, c, t, g, unknown or other
  misc_feature (102)..(102): n is a, c, g, or t
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattcgaccagtctccatcctccctgtctgcatctagttggagacagagtcaccatcacgttggccgggcgagtcgacggccatcagcgtatttcgttagccgtggttgcagcaagaaccgnggccgacgcccctanagagtcgtagtctagtggtcnctagtccgagtagttcggacgtaaggggtcgggtacccctagttcccgtaggttaccgaggtacggactaggtcgaccgtaggttaccggagggaactaagttaacctttaaccaccgtttaccttaccgaaactttacgaccgaacggtccaccggtacccgttacggaaccctacgggttacctaagggttaaactttacggttttttacgaacttttaaacgttttttaaccgttaaccgtacgtttaaaaccctaaggttaaacgttttaaaccgtttaaccgttaacccgggtttaaacccccgttaagggggttacccgggttaaccggtttaccccgggggaacccggtaaagggggtaaccccggttaaaaggggtcccggtaaaaccgtacccgtaaaaccggtcggttacgggtacgggtacctcgggtaacccc

SEQ ID NO: 214622 - DNA, 701 bp, Homo sapiens
  misc_feature: GYAE6OF01D3MJC.1.34.D01.1.454.CMB.1.raw
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgctatctattggagacagagtcaccatcacgttgccgggcgagtcgaggccatcagcgtattcttagccttggttgcagacaagaaaccgngggccgacgcccctnagactcgtagtctagtggtgcactcgagtatgacgtaaggggtccggtccagtccaggttcaggtcggcagtgctagtcgagggacagtacttacacttntactactatcagcacgccctagcacgtaccgttagtaaagtttacgttttagtaacttttaaacgttttaacgtttaactacggtttaaaccctaaacgtttaaggttttaaaccttttaaaccgtttaaccccggttaaaccccccggttttagggttacccggggttaacccgggtttaccccggggtaacccggggtaaaccggggggtaacccggttaaaggggggttaccgggtaaaaccggttacccgggtaaaacgttaacccgggttaagggttaccgggttccggtaacggtaaccccgg

SEQ ID NO: 214623 - DNA, 676 bp, Homo sapiens
  misc_feature: GYAE6OF01BBCIS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactccctccctgtctgcacttctattggagacagacgtacaccatccacttcggccgggacgagtcgaggcctatcaagtcgtatttctttacgccgttggttcgcagacaacggaaaccgacgggccgaccggcccctacgacgtagtaccggtagttcgtagtgggtacgacgtactacctaggtacgttacggacggtaaggggttccgggtaccctacgttcccgtaggttcgacggtcggtcgtagtcgtactagtcggtagggacagtacttacgtacttaccgtacacgttataccgaagtaccacgtccgtacgacctacgtccgtaagtacgttatttacgtacttaagtttacttacgttacgtactaaacgtttagtaacgtttacgttaaccgttaccgttacgggtaccggtacggttaccgggaccggtaacgggaacggtacgggtacgtaacgtaccgtaacgtaacgtgggtacgtcgcggtaacc

SEQ ID NO: 214624 - DNA, 709 bp, Homo sapiens
  misc_feature: GYAE6OF01DBD9G.1.34.D01.1.454.CMB.1.raw
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatcctccctgtctgcatctattggagacagagtcaaccatcacgttggccgggcgagtcaggccatcgagcgtattctttacgccgttggttgcagacaacgaaaccgagggccgacgcccctanagatcgtagtctagtggtgactactccagtagttcggacggtaacggggtcgggtacccctagtcccgtaaggttcgaagggttcggacgtaggtcgtcgtaacgttcggtacgggaactaaggtaactttaaccaccgtttacctaacctacttaactcgaacgtccacgtccgtacgaccgtacgtccgtaaggtaagtttacgttttacgaacgtttaaattttaacgttacgttacgtaactaaacgttagtttaaactttaccggttaaccgttaacccccggttaaggtaccgggttaccggttaccgggtaccgggtaaacgggggaaccggttaaaggggtaacggtaaaccgttaaccgaaacccgggttaagtcgggttacggccgttacggtaaccccg

SEQ ID NO: 214625 - DNA, 811 bp, Homo sapiens
  misc_feature: GYAE6OF01C34O5.1.34.D01.1.454.CMB.1.raw
  modified_base (228)..(228): a, c, t, g, unknown or other
  misc_feature (228)..(228): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctctggctcccaggtaccagctgtgacatccaattcgacccagtcctccactccctccctgtctgcatctatggagacagagtcaccatcacgtgccgggngagtcaggccatcgagcgtattcgttacgcgttggtcgcgagacgaacggaaacccgagggaccgaccgccccctagacgtacgttacggttagtcgtaagtcgggtacgactacgtaccaaggtaacgttacggacggtaaacgggggtttccggggtaacccctaacgtcccggttaacgggtttccgaagggttcgggacctaagggttcgaccgtaaacggttccgggttaaacggggaactaaacgggttaacttaaaccctaccgtttaccttaacccaaacttaacgtaccgaacggacctaaccggtcccctagggaccaacgggttacccgttaaggttaaagttacgttttacgtaacgttttaaactttttaacgtttaccgtaaggttaaccctaaaacggttaagtttaaccgtttaacgttaaacccggttaccccggtacggtttaccgggggtaaccgttacccggggtaacccggtaaacgggggtaacccggtaaggggttaaccgggtaaaacggtacccgtaaaaccggtaacgttacgggtaccggttccgaacgtaacccg

SEQ ID NO: 214626 - DNA, 670 bp, Homo sapiens
  misc_feature: GYAE6OF01E11V6.1.34.D01.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtcngcatctattgganacagatcaccatcacttgccgggngagtcaggccatcagcgattcttagccgtggttgcagacaagaaaccgaggggccgacgcccctcagtatccggtagtctagtggtgcactccagtagttggacgtaaggggtcgggtacccctagtcccgtaggttccaggttcggacgtagtcgctagttcgtaggggaactaaggtaacttaccgtaacgttcctaccgtaacttaacgtacgaacggtcaacggcccgttaggaccgtaccggtacccgttaaggtaagtttaacgtttttacgaactttaaagtttttaacttacgttacgtaactaaacgtaagtttaacttaacgttaaccgttaacccccgttaggtaccggtaccggttccgggacccggtaaggggaaccgtaagggtaacggaaccggttaccgaaacccggttacggttaggtcggtactggtaccc

SEQ ID NO: 214627 - DNA, 665 bp, Homo sapiens
  misc_feature: GYAE6OF01C9I0S.1.34.D01.1.454.CMB.1.raw
  modified_base (100)..(100): a, c, t, g, unknown or other
  misc_feature (100)..(100): n is a, c, g, or t
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (291)..(291): a, c, t, g, unknown or other
  misc_feature (291)..(291): n is a, c, g, or t
tcagacgagtgcgtcacgaccggtgctcgatttagatcgtctgtgttgggtttggggagtcagaccctgtcaggacacagcatggacatgagggtccccntcagctccgtgggctcctgctgctctggctacccgaggtaccagctgtgacatccaattgacccngtctccatcctcctgtctgcattctagttgganacagacgtcaacctntccacgttcggccgggctagtcgaggccatccgagcgtattctttacgccgttggttcacgagtcaacggaaaaccgnggggaccgacgtcccccgtagaggtactcggttaagtccgttaagttgggtcacgtacgtaccgagtacgttcgcgtaaacgggttcggtacccagtcccgtaggttacaaggtcggactaggtcgtaccgtagtcgtacgggaactacggtaactttaccgacttcgtaccgtactacgttacgaacgtccgtacggacccgttgaccgtacgtacgtagttaaacgttgtttacggaactttaacgttttacgtactacggtactaagttcttaacgttacgtaaccttacccggtaggtaccggttcgtacggtaccggtagggtaccgtagggtagacgtaccgaacgtacgtggtacgcgtacgtaccg

SEQ ID NO: 214628 - DNA, 563 bp, Homo sapiens
  misc_feature: GYAE6OF01CA1MU.1.34.D01.1.454.CMB.1.raw
  modified_base (279)..(279): a, c, t, g, unknown or other
  misc_feature (279)..(279): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcggtcaggccatcagcgattcttagcctggtgcagcagaaaccagggcgacgcccctnagatcgtagtctagtggtgcatccagtattgacgtaagggtcggggtccctagtccgtaggttccaggtcggcagtcgcatcgtgggacagtacttacactcctcactatcagcagcctgcagcctagaacgttntttcgacttaatttacttacgtgtactaacgtagttaacttacgtaccgtaccccgttaggtacgggtaccgttaccggccgtaacggggtacctaaaggggtcgaaacgtacccgaaaccggtacgttcggaggcctagcctaacccg

SEQ ID NO: 214629 - DNA, 569 bp, Homo sapiens
  misc_feature: GYAE6OF01CVJ22.1.34.D01.1.454.CMB.1.raw
  modified_base (274)..(274): a, c, t, g, unknown or other
  misc_feature (274)..(274): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaaccatccacttcggccgggcgagtcaggccatcagcgtattctttagcctggttgcagcaagaaaccngggcgacgcccctcagatcgtagtctagtggtgcatccagtattgcgtaaggtcgggtcccagtccgaggttcagtggctagtgcagtcgtagggacagtacttacactctcactatcagcagcctgcagctagaacgtattttgacttaatttattacgtactacaaacgtataactttactaacgttaccccgtaaggtcgggtaccgttacgggaccgtaaggggtacccgtaagggtacggtaaacgtaccgtaaacccgggtaattcgggtaacggtcgtggtaaccccg

SEQ ID NO: 214630 - DNA, 744 bp, Homo sapiens
  misc_feature: GYAE6OF01D7TXW.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctcgtggcctcccgaggtaccagctgtgacatccaattcgacccagtcctccactccctccctgtctgctatctagtggagacagacgtcaccatctacgttcggccgggcagtcgacggccatcagcgtacttctttacgtccgttggttgcgacgacgaacgaaaccgacgggaccggaccgccccgtcgacgtacgtacgtacgtacgtagtggtcgtacgtacgtacgtacgtagttacgtacggtaacgggtacgggtaccgtacgtaccgtacggttacgtacggtcggtacgtacgtcgtacgacgttttttttttttttttttttttttttacggacgggtacgtaacgtaacgttacgtaccttactacgtaactacgtacgacgacgacgtaccgtcgacgacgtacgtacgtaagttaacgtttacgttaacgttaactttaacgttacgttacgtaactaacgttaacgttaacgttaacgttaaccgttaacccgttaccggttacgggttaccggttaccgggtaccgggtaacgggtaaccggtaacgggtaacggtaacggtaaccgtaaaccggtaacgtacggtacggtcgtcgtaccg

SEQ ID NO: 214631 - DNA, 532 bp, Homo sapiens
  misc_feature: GYAE6OF01EWCMA.1.34.D01.1.454.CMB.1.raw
  modified_base (284)..(284): a, c, t, g, unknown or other
  misc_feature (284)..(284): n is a, c, g, or t
  modified_base (525)..(525): a, c, t, g, unknown or other
  misc_feature (525)..(525): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcaagaaaccgagggcgacgcccctnagtatcgtagtctagtggtgcatccagtattgacgaagggtcgggtcccagtccgaggttcaggtgcagtgcatcgtagggacagtattaccactctcactatcagcacgcctgccagcctagaagttatttgacttaatttattactgtactaactagttattacgtacgtacccttaggtacggacgttcggaccgtaaggggaccgaaggtcggaacgtaccgaacgtactggcggtntcgtacc

SEQ ID NO: 214632 - DNA, 572 bp, Homo sapiens
  misc_feature: GYAE6OF01BJLQS.1.34.D01.1.454.CMB.1.raw
  modified_base (102)..(102): a, c, t, g, unknown or other
  misc_feature (102)..(102): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
tcagacgagtgcgtcacgaccggtgctcgatttagatcgtctgtgttgggtttgggggagtcagaccctgtcaggacacagcatgggacatgagggtccccnctcagctccgtggggctcctgctgctcgtggctcccaggtaccagtctgtgacatccaattgacccagtctccatccctccctgtctgcatctattggagacagagtccaaccattccacgttcggccgggganagtcaggccatcgagcgtattcttagctggtncagcaagaacgagggccacgcccctnagtactcgtagtctagtggtgctatcagtattggcgaaggggtcggaccctagtcccgtaggttcaggtcgcgtagtcgactatcgtagggacagtactacactntacactatcaggctagctgcncgactagaattnttacgatttaattactacgtntacaacgtagtattacgacgttaaccctgggttcgaaccggttcggaccggtaagggaaccgtagggtaacggaaacgtacccgtaaacggtaccgtaggtacggtccgtacgaacccg

SEQ ID NO: 214633 - DNA, 642 bp, Homo sapiens
  misc_feature: GYAE6OF01DI2J0.1.34.D01.1.454.CMB.1.raw
  modified_base (102)..(102): a, c, t, g, unknown or other
  misc_feature (102)..(102): n is a, c, g, or t
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattcgacccagtctccactccctcctgtctgcatctagtgganacagactcaccatcacgttcggccgggcgacgtcaggccatcagctatttcttagccgttggtncagcgaagaaccgngggccaccgccctnagtgtacgtagtctagtggtnactagtccagtagttgacggtagggtccggtaccctagtccgtaggttcgaggtcggactaggtcacgtacgtcgtagggaactagtacttaccgacttcctacgattacgtcgacgtacacgtcctggtacctacgtccgttaagttaaacgtttcttttacggtaactttaagtttttactaccgtacgttaaactaaagttaggttaacttaccgtaaccgtacccgttaggtaccggtaccgttaccgggaccggtaaggggtaaccctaaggggtaaccgtaacgtaacccgtaacggttacacgggttacgcgtccggtaacc

SEQ ID NO: 214634 - DNA, 389 bp, Homo sapiens
  misc_feature: GYAE6OF01CKKEZ.1.34.D01.1.454.CMB.1.raw
  modified_base (266)..(266): a, c, t, g, unknown or other
  misc_feature (266)..(266): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (384)..(389): a, c, t, g, unknown or other
  misc_feature (384)..(389): n is a, c, g, or t
tcagacgagtgcgtcacgaccggtgctcgatttagatcgtctgtgttgggtttgggagtcaggccatcagcgattctttagcctggttgcagcagaaaccagggcgacgcccctcagatcgtagtctatggtgcatccagattgcaaggtggggtcccatccaggttcagtggcagtgcatcgtgggacagattacactctcactatcagcagcctgcagcctagaagtattttgacttaattttatactgtacaactagtattanacgtaccctagtggacttcggccaggggaccaaggtgaacgtcaacgactgtgctgcacatctgtcttnactcttcccgccctcncacgcactcgtngagcgggctgcaaggcnatgnnnnnn

SEQ ID NO: 214635 - DNA, 658 bp, Homo sapiens
  misc_feature: GYAE6OF01DJMZT.1.34.D01.1.454.CMB.1.raw
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagccttggttgcagcaagaaaccgagggcgacgcccctanagntcgtagtctagtggtnactatccagtacttggacgtaaggggttcgggtaccccagttcccgaggtttcaggttcgacgtaggtcgactagtcggttagggaactaggtaactttaccaccttactacaactactcaagcaacgtccctgacccgtagcccgttaaggtaacgtttagtttttcgaactttaaatttttacttaacgttagtaacctaaacttagtttaactttacgttaacccggttaaccccgttacgggttacggttaccggttccgggaaccggtaagggggtaacccgtaaaggggttacgggtaaacgtaacccgtaaaccggtaacgttgggtacggtcctcggtaaccccg

SEQ ID NO: 214636 - DNA, 407 bp, Homo sapiens
  misc_feature: GYAE6OF01D8R95.1.34.D01.1.454.CMB.1.raw
  modified_base (397)..(407): a, c, t, g, unknown or other
  misc_feature (397)..(407): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcaggtggcagtgcatctgggacagtattacactctcactatcagcagcctgcagcctagaagtattttgacttaattttattactgtacaacagtattatacgtaccctagtggacttccggccagggggaccaagggtggaacgtcaaccgaactggtggctgcaccatctgtcttcactctccgctatctgaacgcactcgtctgagcggctaggcgaggcacatagcnnnnnnnnnnn

SEQ ID NO: 214637 - DNA, 652 bp, Homo sapiens
  misc_feature: GYAE6OF01BKEV9.1.34.D01.1.454.CMB.1.raw
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
  modified_base (423)..(423): a, c, t, g, unknown or other
  misc_feature (423)..(423): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggngagtcaggccatcgagcgtattcttagccgtggttgcagcaagaaaccngggccgacgcccctagagatcgtagtctagtggtnctatccgagtattgcgtaaggggtcgggtcccagtcccgtaggttcaggtcggctaaggtgaccgtagtcggtacggggaatacgtaattacccgtaacttcgtacctacgttaanctacggacctacggcccttggaccacgtacccggtaagtaaacgtttattttacggacttaaattttaacttacgtagttaacctaaacgttacgttaactttacgtaaaccgttaccccgttaaggttaccgggtaccgttaccggggaccggtaaaccgggggtacctaacggggtacggtaaaccgtacccgtaaacggtactagggtacgggtctcggtaacccg

SEQ ID NO: 214638 - DNA, 732 bp, Homo sapiens
  misc_feature: GYAE6OF01BQXZE.1.34.D01.1.454.CMB.1.raw
  modified_base (348)..(348): a, c, t, g, unknown or other
  misc_feature (348)..(348): n is a, c, g, or t
  modified_base (463)..(463): a, c, t, g, unknown or other
  misc_feature (463)..(463): n is a, c, g, or t
  modified_base (725)..(725): a, c, t, g, unknown or other
  misc_feature (725)..(725): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacgttcggccgggacgagtcgacggccatccgagtcgtaatttcctttaggcccgttggttcgacagaccgaaacggaaaacccgaggggcccgaccgccccctacgagtacgttacggttagtcttagtgggtacnctactccaagtagttcggacggtaacggggttcgggtacccctaaggtcccgtaggttaccgaaggtcggactaggtcgactacgtcggtacgggtactaacggtactttaaccnccgttacctacctaacgttacgtacgacggtacctacggccccgttaggaccgtaaccggtacccgtttaagggtaaacggttttacttttttaaccgaactttttaaacgttttacttaccgttacgtaaaccttaaacgttagttaactttaaccggttacccggtaacccgttagggttaccgggttaccggttccgggaaccggtaacggggttaccgtaagggtacgtaaaccgaccgtaacggtacgttggcgtcncgtaccg

SEQ ID NO: 214639 - DNA, 618 bp, Homo sapiens
  misc_feature: GYAE6OF01CER3I.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgtattctttagcctggttgcagcagaaaccngggcgagcccctnagatcgtaagtctagtggtcgcactccagtacgttggcgtaaaggggtcgggtacccctagtcccgaggtttcaaggtcggacctaggtcgacgtagtccggtagggaacctaaggactttaacgacttctacctaactactacaagccaacgtcccgtagcctacgtccctaggtaaacgttacttttagaacttaattttaacgttaccttagtacctaaacttaagttaacttaacgttaccgtaccccgtagttacgggtaccgtttcggaccggtagggaaccgtaagggtacggtaagtaccgaacgtaacgtggaacgtccgtggaaccc

SEQ ID NO: 214640 - DNA, 717 bp, Homo sapiens
  misc_feature: GYAE6OF01ECZ7E.1.34.D01.1.454.CMB.1.raw
  modified_base (102)..(102): a, c, t, g, unknown or other
  misc_feature (102)..(102): n is a, c, g, or t
  modified_base (205)..(205): a, c, t, g, unknown or other
  misc_feature (205)..(205): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (709)..(709): a, c, t, g, unknown or other
  misc_feature (709)..(709): n is a, c, g, or t
tcagacgagtgcgtcacgaccggtgctcgatttagatcgtctgtgttgggtttgggggagtcagaccctgtcaggacacagcatggacatgagggtccccgntcagctccgtggggcctcctgctgctcgtggcctcccaggtaccagctgtgacatccaattcgacccagtctccatccctccctgtctgctatctagttgganacagacgtccacctatctacgttcggcccgggcgagtccgaggtccatcgagtcgttatttccgttacggtccgttggtcgacacgacgaaacggaaccggnggaccctaccgccctagagtcgttcgtacgttcgtaggtcggnactacgtcgagtaggtcggaacggtacgggttcccggtacctaagtccgtaagttcgaggtcggacgtaggtcgacgttacggtacgagggtaacttaacgtacctttaacccaccgtttcctaacgtaactacgtcgactaccggtactccgtagaccgtaccggtttactaaggttagtttacgttttacgaaacttttacgttaagtccgttaactaaacgtaacgttaatttaaccggttaacgttcccccggtacggtagggttcccggtaacgggtacccgggaagggttaacccgggtaggtaacgggtaaacgtaacgaacccgtaccgggttaagtccggtacggtaccngttacccg

SEQ ID NO: 214641 - DNA, 724 bp, Homo sapiens
  misc_feature: GYAE6OF01BGYJB.1.34.D01.1.454.CMB.1.raw
  modified_base (202)..(202): a, c, t, g, unknown or other
  misc_feature (202)..(202): n is a, c, g, or t
  modified_base (466)..(466): a, c, t, g, unknown or other
  misc_feature (466)..(466): n is a, c, g, or t
tcagacgagtgcgtcacgaccggtgctcgatttagatcgtctgtgttgggtttgggagtcagaccctgtcaggacacagcatggacatgagggtccccgctcagctccgtggggctcctgctgctcgtggcctcccaggtaccagctgtgacataccaattcgacccagtcctccactccctcctgtctgctatctatgganacagatcacatcacgtcgccgggcgagtcaggccatcagcgtatttcttagcctggttcgcagacaaggaaccgaggggccaaccgcccctagacgtacgtcgttagtcttagtcggtacgactacgtccaaggtagttacggaacggtaacgggggttccggtacccctaaacgttcccgtagggttacgaggtcggaccgaggttcacgttacgtacggtacgggataacgtaacttaccgtacttcctaactaacgttacncgaacgtcacgtccgtcgctacgtccgttaagtaacgtttcgttttacaacgttttaatttacgttactagttaacctaaagtttactttaaacgttacctaaccccgggttaacccgtttaggggttaacccgggttacccggttacccgggtaacccgggtaacgggggttaaacgtaacgggggttaaacggtaaacccgtaacccggtaaacccggttaaggttacgggttaaccgtccgttaaacccggaccc

SEQ ID NO: 214642 - DNA, 573 bp, Homo sapiens
  misc_feature: GYAE6OF01DLJ7P.1.34.D01.1.454.CMB.1.raw
  modified_base (102)..(102): a, c, t, g, unknown or other
  misc_feature (102)..(102): n is a, c, g, or t
  modified_base (273)..(273): a, c, t, g, unknown or other
  misc_feature (273)..(273): n is a, c, g, or t
tcagacgagtgcgtcacgaccggtgctcgatttagatcgtctgtgttgggtttgggggagtcagaccctgtcaggacacagcatggacatgagggtccccgntcagctcctgggctactgctgctctggctcccaggtaccagctgtgacatccaattgacccagtctccatcctccctgtctgcatctatggagacagagtcaccatcacttggccgggcgagtcaggccatcagcgtatttctttagccttggttgcagcaacgaaaccgngggcgacgcccctcagactcgtagtctagtggtgcatccagattcgacgtaagggtcgggtaccagtccgaggttcaggtggcagtgcagtcgtgggacagtactacactctcactatcagtcagtcctgcctagccttaggtaacttacgttttgaactttaattttacgttaacgtgttaacaacgttagttaacttaacgtaccgttaaccccgtaggtccggttaccggttaccgggaccgaaggggtaaccaagggtacgaacgtaccgtaaaccgtagtcgtacggctggaccc

SEQ ID NO: 214643 - DNA, 520 bp, Homo sapiens
  misc_feature: GYAE6OF01E1PZC.1.34.D01.1.454.CMB.1.raw
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattcttagcctggttgcagcagaaaccagggcagcccctnanatcgtagtctatggtgcatccagattgcaagggtcgggtccatccgaggttcagtggcaggtcgcagtcgtgggacagtactacactctacactatcagcacgcctgcagcctagaagtntttagacttaatttatactgtacaactagtattactacgtacccgtagttcggtacgttcggccgtaaggggacctaagggtacggaacgtaccgaaaccgtaactgggtcgcgtgacccg

SEQ ID NO: 214644 - DNA, 802 bp, Homo sapiens
  misc_feature: GYAE6OF01CWLZ0.1.34.D01.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagacgagtgcgtcacgaccggtgctcgatttagatcgtctgtgttgggtttgggggagtcagaccctgtcaggacacagcatggacatgacgggtcccccgctcagctccgtggggctcctgctgctctggcctcccaggtaccagctgtgacatccaattcgacccagtcctccatcctccctgtctgcattctagtggagacagacgtccaccatcctacgttcggccgggacgagtccgacggccatcgagtcgtaatttcgtttacgccgttgggtcgacgtagccgaacggaaaccgngggaccgtaccgcccccgtnaagtacgtcggtacgtaccgtagtcggtcgactacgttaccgaagtacgttggaccgtaacgggggttcggtacccctacgtcccggtaggttacacgggttcggcgtaaggtcggtactacgtacggtaggggaacctagttaaccttaccgtacttccgtaacgtacttaacgtcgaacgacctaccggcctaccggacgtaccgaccgttaagtaacgtttacgttttacgtaactttaagttttaacgttaacgttacgtaaccgttaaacgttaagtttaaccgtttaaccgttaacccggtttaaccccccgttaaaggggtttccggggtaaaccgggtttacccgggggtaaacccggggttaaacccggggtaaaccgggtttaaacggggaacccgggttaaaccggtacccccgttaaaacggggtaacccgttggggtacggtaacccgtacggttaaacccccg

SEQ ID NO: 214645 - DNA, 680 bp, Homo sapiens
  misc_feature: GYAE6OF01CI40Z.1.34.D01.1.454.CMB.1.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (327)..(327): a, c, t, g, unknown or other
  misc_feature (327)..(327): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagacgtcaccatccacttcggccggggcgagtcaggccatcagcgtattcgttacgccttgggttcncagcgaagaaaccgngggccgacgcccctgagatcgtagtctagtggtgctatccagtnttaggacgtaacggggtcgggtcccagtccgtaggttcgaggtcggactaggtcgactacgtcgtagggactaggtacttacactcgtacactaatcgacgtcgacgtccgtagaccgacgtaccgtaaggtaacgtttacgttttacgaactttaattttaacgttacgtacggtttaacctaaacgttaagtttaactttaccggttaaccgttaaccccgttacgggttaccggttaacccggttaccgggaacccgggtacggggtaaaccggtaacggggttaaccgggtaaaaccggttaccgtaaacccggtacggtttaggacccgggtcgttaccggtaacccg

SEQ ID NO: 214646 - DNA, 638 bp, Homo sapiens
  misc_feature: GYAE6OF01BQLYT.1.34.D01.1.454.CMB.1.raw
  modified_base (203)..(203): a, c, t, g, unknown or other
  misc_feature (203)..(203): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctattggagacagntcaccatcacttggccgggcgagtcaggccatcagcgattcttagcctggtgcagcgaagaaaccgngggcgacgcccccgtanagactcgtagtctagtcgggtnctatccaagtagttcggacgtaaaggggttcggggtacccaagttacccgaaggtttccgaagttgggaccgtaaggttcgctagtccgtaggggaacctaaggtactacaaccttctacactactacgaagccaagccctgactacgaccgttagaaacgttattttacgaccttaaagttttaacttacgtagttaaccaaattacgtaatttaactaccggttaacccgttacggtcgggttaaccggttcggaccgggtaacgggaaccggtaaagggcggtaaacgtaacggaaaccccgtagttaggcggtccgtagaacccg

SEQ ID NO: 214647 - DNA, 575 bp, Homo sapiens
  misc_feature: GYAE6OF01AR3H4.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccgagggcacgccccctcagatcgtagtctagtggtgcactccagtattgacgtaaggggtcgggtcccagtccgaggttcaggtggcagtgcagtcgtagggacagtacttaccgacttcctacaactactcagcacgcctagactacgcctagaagttattttcgacttaaagttttactaccgttgtaacctaaactagttaattaacgtaccgttaaccccgttaggtacggtaccggtttcggccggaaggggtaaccaaggggttacgaacgttaccaaacccggtacgtaggtcggctgaccc

SEQ ID NO: 214648 - DNA, 655 bp, Homo sapiens
  misc_feature: GYAE6OF01EKBOD.1.34.D01.1.454.CMB.1.raw
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcgagtcaggccatcagcgtattctttagccttggttgcagcaagaaaccgngggaccgacgcccctagagtagttcgtagtctagtgggtcnctatccgagtattaggacgaaggggttcgggtaccccagtccgaggttcgaggtcggcaggtgccgtagttcggtacggggaactacggtaacttacctaccttcctactaacttactcgaacgctacgccgttacgacgaccgttaccgtaggttaacgtttattttcgtaactttaattttaacttacgtagttaaccaaagttacgtttaattaacgttacccgttaccccgtacggttacgggtacccggtttccgggaccggtaaccgggggtaaccgtaagggttacgggtaaaccgtaccgtaaaccggacgttacgggtgccgttcggaaccc

SEQ ID NO: 214649 - DNA, 674 bp, Homo sapiens
  misc_feature: GYAE6OF01BRL86.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggcagtcaggccatcagcgtattcttagcctggttgcagcaagaaaccgagggaccgacgcccctcgagtacgttcgtagtctagtggtacgcactccgaagtagttgacgtaacgggtcggtaccctacgtccgtaggttcaaggtcggacgtaggtcgacgtaagtcggtacgggaactaagtaaccttaccgacctttccgtacctaacttaagtccaacggcaaccggtcctaggaccgtaacccggtcgtaaggttaaagtttcgtttttacgaactttaacgtttttaacttaccgttacgttaaccttaaagtaacgtttaactttaaccgttacccgttaacccggttagttccgggtaacccggtttcggaaccgggtaacgggtaaccggtaaggggttagtaaacccggtacgaaacccgtagtcggtagtcccgtagtacccg

SEQ ID NO: 214650 - DNA, 686 bp, Homo sapiens
  misc_feature: GYAE6OF01CSYZV.1.34.D01.1.454.CMB.1.raw
  modified_base (202)..(202): a, c, t, g, unknown or other
  misc_feature (202)..(202): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctagttggagacagngtcaccatcacttgccgggcgagtcaggccatcagcgtattcttagccttggttgcagcagaaaccgnggggccacgcccctnagagtcgtagtctagtggtncatccagattgcgaagggttcgggtacccagtccgagggttcaggtcgggctaggtcgacgagttcgtaggggaaccaggtaaccttaccaccgttcctaaccgtacttaacgtaccgacggtaccgaacgggtcccttacgggacctaacgggtcccttaggtaaaacgtttcgtttttaacacgtttaaattttaatttacgtacgtaacctaactaagtttaacgttacgttaccgttaacccccgttagggtaccgggtaccggtttaccgggaacccgggttaacgggggaaaccgttaacgggggtaacgggttaaaacgtaccccggtaaaaacccggtacggttaggggtacccgtacggttccggtaacccg

SEQ ID NO: 214651 - DNA, 516 bp, Homo sapiens
  misc_feature: GYAE6OF01A16G4.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtcgggtccagtccaggttcagtggcagtgcatcgtgggacagtattacactctacactatcagcagcctgcagcctagaagtattttgactaattttatactgtacaactagttattactacgtaccctagtcggtaccgttcggaccgtaggggacctaagggtacggaagttaccgaaaccgtactggtcggctgaccg

SEQ ID NO: 214652 - DNA, 730 bp, Homo sapiens
  misc_feature: GYAE6OF01DT6KC.1.34.D01.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtggttgggtttgggggagtcagaccctgtcaggacacagcatggacatgagggtccccgctcagctcctgggctcctgctgctctggctcccaggtaccagctgtgacatccaattcgacccagtctccatcctccctgtctgcatctatgganacagagtcaccatcacttgccggcagtcaggccatcagcgtattcttagcctggttcgcagcaacgaaaccagggtcgacgcccctnagtactcgtagtctagtggtcacatccagtattgacgtaaggggtcgggtaccccagttccgaagggtttccaaggttcggccgtaaggtcgactacgtcgtaggggaactaggtaactttaaccgaccttacctacgtaaacttatccgaaacgtcctacggtcccgttaggacccaacggtcccgttaaggtaaaacgttttcgtttttaacgggacttttaaaaacgttttttacttaaaccggttacggttaacctaaaaacgtttacgtttaaaacgttttacccgttaaacggtttaaacccccccgttagggttaacggggttaaccggtttcccggggaaccggtaaacggggggtaaccctaaaaggggttaccgggaaacgttaaaccccgtaaaccgggttaaaccttgggttaaccggcccttaggtaaccccc

SEQ ID NO: 214653 - DNA, 771 bp, Homo sapiens
  misc_feature: GYAE6OF01DCLOY.1.34.D01.1.454.CMB.1.raw
  modified_base (199)..(199): a, c, t, g, unknown or other
  misc_feature (199)..(199): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtcgacatccaattcgacccagtctccatcctcctgtctgcatctatgganacagagtcaccatcacgttcggccggcgagtcaggccatcgagcgtatttcgtttacgccgttggttcgcgaacgacgaacggaaaaccgaggggccgacgtccccctagaagacgttcggtaagttcctagttgggtcgtactacgttccgaaggtacgtttcgggacggtaacggggggttccgggtacccctaagtacccgtagggtttccgaggttcgggactaggtgcctagtcgtagggaacagtacttaccacttaccgtacaacttactcacggactacggccctaggacccgtaagtccgttaaggtaaacgtttcgtttttaacggaaccttttaaagttttaccgttaaccgttacgttaaacctaaacgtttaacgttttaaacgtttaccgttaacccggtttaaacccccgttaggggttacccgggttaaccggttacccggggaacccggtaaacggggggttaaaccccgtaaaagggggttacccgggtaaaaccgttaccccggtaaaaccggttaacggttggggtacccggtaccgttaacggaaaccccg

SEQ ID NO: 214654 - DNA, 683 bp, Homo sapiens
  misc_feature: GYAE6OF01DCFSA.1.34.D01.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtctccatcctccctgtctgcatctatgganacagatcaccatcacttgccgggcagtcaggccatcagcgtattcttagccttggttgcagcaagaaaccgngggccgacgcccctanagatccggtagtctagtggtcgactatccagattggacgtaagggtccgggtacccattccgtaggttacaggttggactagtcgctaacgtcgtagggacctaggtaacttaaccnccttacgttaccaacttacgtaccagtaccgacgtcccgtaggccgaacgtccgttaaggttaaacgtttacgttttacgtactttaaaactttttacgtttaccgtaacgttaactaaaccgttaagttttaaactttaaccgttaaaccggtttaacccccctaggggtttaccggtaacccgggtttacccggaaccggtaacgggggtaaccgtaaggggtaacggtaaaccggtaaccgtaaaccgttaacgtgggttaaccgcgtacgtaacccg

SEQ ID NO: 214655 - DNA, 633 bp, Homo sapiens
  misc_feature: GYAE6OF01EETLD.1.34.D01.1.454.CMB.1.raw
  modified_base (200)..(200): a, c, t, g, unknown or other
  misc_feature (200)..(200): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatggagacagngtcaccatctacttggccgggcgagtcaggccatcagcgtatttcgtttacgccttggttgcagacaacgaaccgagggccgacgcccctgagtacgtcgtagtctagtggtcgactatccgaagttctggacgtaacgggtcgggtacccagtcccgtaggttcgaggtggacgtaggtcgactagtcgagggaactaagtacttaaccgaccttcctactaacttactacgagtccacgccgtaggaccacgtccttaaggaagttttaagttttcgaactttaaagtttttaactcgttataaccgtaaacgttagttaacttaacgtaacccgttacccgtaggttacggtaccgttaccgggaccgtaaggggaacccgtagggtacgaaagtcccgtaaacggtacgtaggtcggtcctcggtaacc

SEQ ID NO: 214656 - DNA, 822 bp, Homo sapiens
  misc_feature: GYAE6OF01B3R6X.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacataccaattcgacccagtctccatccctcctgtctgcatctagtggagacagactcacatccacgttcggccgggcgaagtccgaacggcctagtccgaagtccggtaacttttccgtttaggcccgtttgggttacgaccgaaggaccgaaacgggaaaacccggacggggccggaacccgaccccccgttagaacggtacgttaccggttacgttaccgttaagttgggttacacctaacgtacccgtaagtacggttacggaaccggttaaacgggggttccgggtaccctaaggttacccggtaaggtttaccgagggtcgggacgtaacggttgaccgtaaggttaccggtaggggaaactaaggttaacctttaaccctacgtttaccgtacctaaccttagtaccgaagcccgtaacgttccgacggacctaacggtaccgttaaggtaactttaggttttacaacttttaacgtttaactaaccgttacgttaaacaagttaactttacgttaacctaacccggttaccccgttaagggtaccgggttaaccggttaccgggaaccggggtaacgggggtaaccttaaacgggggtaacggtaaaccgttaaacccggaaaccggtacggttttaggggactaacccggttgtaaacccccg

SEQ ID NO: 214657 - DNA, 398 bp, Homo sapiens
  misc_feature: GYAE6OF01BY7M2.1.34.D01.1.454.CMB.1.raw
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (385)..(386): a, c, t, g, unknown or other
  misc_feature (385)..(386): n is a, c, g, or t
  modified_base (388)..(398): a, c, t, g, unknown or other
  misc_feature (388)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtcaactagtattatagtaacccctagtggacgttcgaccagggggaccaaggtggaatcaaccgaactgtggctgcaccatctgtcttcntccttcccgcatcnacncactcgctgagcgggctgcaaggcacatgnngnnnnnnnnnnn

SEQ ID NO: 214658 - DNA, 597 bp, Homo sapiens
  misc_feature: GYAE6OF01BZFZ0.1.34.D01.1.454.CMB.1.raw
  modified_base (451)..(451): a, c, t, g, unknown or other
  misc_feature (451)..(451): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcaagaaaccgagggccgacgcccctcgagtatcgtagtctagtggtgctatccagtattgacgaagggtcgggtacccagtcccgaggttcgaggtcggcgtagtcgctacgtcggtagggtaacagtaacttacctacttccgtacaacttacgtacacgacacgcctgaccacgtccgtagtaagttntttacgacttaatttacttgtcgtataactagttattactaaccgttacccgtagtacgggtaccgttcgggaccggaaggggtacccgaagggtaccgggtaaagtacccgtaaacggtacgttgggtacggtcgtcgtaacccg

SEQ ID NO: 214659 - DNA, 517 bp, Homo sapiens
  misc_feature: GYAE6OF01BHFPM.1.34.D01.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcagtcaggccatcagcgtattctttagcctggttgcagcaagaaaccngggccacgcccctnagatcggtagtctatggncatccagattgacgaagggtcggtacccagtccaggttcaggtggcagtgcatcgtgggacagacttacactctacactatcagcagcctgcagcctagaacgttnttttacgacttaatttatactgtacaagtattacttactacgtaccctagtcggtacgttcggacgtacgggactaggacgaacgtacgaaccgattaggcgctgaccg

SEQ ID NO: 214660 - DNA, 909 bp, Homo sapiens
  misc_feature: GYAE6OF01CBVGO.1.34.D01.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatcctcctgtctgcatctatggagacagagtcacatcacttggccggngagtcaggccatcagtcgtatttcgtacgtcgttggtcacgagacgaaacggaaaccggacgggaccgtacccggtacccctagaacgttacgttaccggttaacgttccgttaggtttcgggtaccgacgtaccttaccgaaggttacgttacgggtaacgggttaaaccggggggttacccggtacccctaacggttacccgggtaacggtttaccggaaagggtcgggtaaccgtaagggttccgtaaccgttacggtttaccggggttaaacggggaacgttaaacgtttaaacccgtttaacccgtacccgttttaacccgtaacctttaaccggttaaacttacccggtaaacggaccccggttaacgtcccggttacggaaacccggttaaccggttacccgtttaaaggttaaacgtttttaacgttttaccttaaaagtttttaacttttaaacgtttaccgtaaccgttaaacccttaaagtttaagttttaaaccttttaaccggttaaccccggtttaacccccggtttaaggggttaccggttaacccgggtttacccggggaaaccggggttaaacccgggggtaacggttaaaccgggggttaacgggtaaaaccccgttaaccggaaaacccgggttacgtaggggtttaacccgccggtaccgtaaacccg

SEQ ID NO: 214661 - DNA, 729 bp, Homo sapiens
  misc_feature: GYAE6OF01DPPLX.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcaccatcacttcggccgggcgagtcaggccatcagcgtatttcgttacgccgttggttcgcgagacaaacggaaaacccgacggggccgtacgccccctagaaggtacttcggtacgttcttagtgggtcactacgttccgaagtattggaccggtaaggggttaccggggtaccccaacgttacccggtaacgggtttcgaagggttcgggactacgggtcggtactagttccgggtaggggaaactagggttaacctttaaccaccgttaccgttacctaacttaacgtcgtaacggcctaccgtcccgtggaccgtaacggtccgtaaggttaaactttgtttttacgaactttaaattttacgttaccgtacgtaacgtaacttagtttaaccttacgttaaccccggttacccgttagggttacggtaccgggttaccgggaccgggtaagggtaccgtaaacgggggtacgaacggtaacccgtaaacgggtacgttagggtcggccgtgtaacccg

SEQ ID NO: 214662 - DNA, 646 bp, Homo sapiens
  misc_feature: GYAE6OF01EFWT2.1.34.D01.1.454.CMB.1.raw
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattcgacccagtctccatccctccctgtctgctatctattggagacagagtccaccatcacgttcggccgggacgagtcgacggccatcagtctatttcttagccgttggttcncagacaagaaaccgngggcgacgcccctagagtactcgtagtctagtggtnctatcagtatgacgagggtcggtaccagtcgaggttcaggtgacgtaggtncgtacgtcggaggaactagtaacttacacctctacgacttacacgagcacgctcgaccacgtccttagtaacgtttactttacgaatttaacttttacgttacgtaagttaccgttaaacttagtttaaccttaacgtttacccggttaaccccttagggttaacccggtacgggtttacccggaaccgggtaacgggggtaacccggtaagggttaaccgggaaacttaaccccggtaaacgtaacggtttggacggtccgtcggaacccg

SEQ ID NO: 214663 - DNA, 548 bp, Homo sapiens
  misc_feature: GYAE6OF01DEJLN.1.34.D01.1.454.CMB.1.raw
  modified_base (223)..(223): a, c, t, g, unknown or other
  misc_feature (223)..(223): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttggggtttgggggagtcagaccctgtcaagacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgtattcttagccttggttgcagcaagaaaccgagggcgacgcccctnagatcgtagtctagtggtgcatccagattgacgaagggtcgggtccatcccgaggttcaggtggcagtgacagtcgtgggacagtaacttacactctcactatcagcacgtcctgccagtcctagaagttatttgacttaattttactactgtacaactagttaacttagtaccgttaccccgttagtcgggtaccggttcggaccggtaaggggtacctaagggtacggaaactacgaaaccgtaatgggacgcgtgaccg

SEQ ID NO: 214664 - DNA, 539 bp, Homo sapiens
  misc_feature: GYAE6OF01ASVND.1.34.D01.1.454.CMB.1.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (533)..(533): a, c, t, g, unknown or other
  misc_feature (533)..(533): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtccaccatcacttggccgggcgagtcaggccatcagcgattctttagcctggttgcagcaagaaaccgngggccacgcccctnagatcgtagtctagtggtgctatccagtattgacgaagggtcgggtacccagtccgaggttcaggtggcagtgcatcgngggacagtattacactctcactntacgagcacgcctagcagtcctagtaacgttntttagacttaatttactactgtacaagtattacttacgtaccgtaccctgtacggtacgttcggccgtaaggggacctaagggtacggaaagtccgaaaccgtagtggtcggntggacc

SEQ ID NO: 214665 - DNA, 424 bp, Homo sapiens
  misc_feature: GYAE6OF01CVM8S.1.34.D01.1.454.CMB.1.raw
  modified_base (409)..(409): a, c, t, g, unknown or other
  misc_feature (409)..(409): n is a, c, g, or t
  modified_base (416)..(424): a, c, t, g, unknown or other
  misc_feature (416)..(424): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtgggtcccatccaggttcagtggcagtgcatctgggacagattacactctcactatcagcagcctgcagcctagaagtattttgctaatttattactgtacaactagtattactaacgtacccctaggtcggtaccgttcggaccgtagggggacctaagggtggaacgtaccaaccggtaactggtcggctgcacatctagtctcactccttccgctatctagaacgcactcgtcgtgacgcggctcggacaagggccncagtagnnnnnnnnn

SEQ ID NO: 214666 - DNA, 769 bp, Homo sapiens
  misc_feature: GYAE6OF01CER5L.1.34.D01.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacgttgccgggcgagtcaggccatcgagcgtattctttagcctggttgcagcaagaaaccgagggcgacgcccctnagatcgtagtctagtggtgcatccagtattgacgtaacgggtcgggtacccagtcccggtaggttccaggttcggctaggtcgacgtagttacggtaggggaactaggtaactttaaccgtaccgttaccttaaccgtaacctttaacgtaccgaaaggtacccgtaacggtcccgttacgggacctaaccgggtacccgttaaggtaaacgtttaacgttttttaggaaccttttaaagttttttaaccgtttaaccgtttacggttaaaccttaaaaccgttaagttttaaacgttttaaaccgtttaacccggtttaaaccccccgtttaagggttaccggggttaaacccgggtttacccggggaacccgggtaaacggggggtaaacccgtaaacgggggttaaacgggtaaaaccgttacccggtaaaaacccgggttaacggttagggttaccggtccggttacgtaaaccccgg

SEQ ID NO: 214667 - DNA, 541 bp, Homo sapiens
  misc_feature: GYAE6OF01BETJX.1.34.D01.1.454.CMB.1.raw
  modified_base (243)..(243): a, c, t, g, unknown or other
  misc_feature (243)..(243): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggtgcagcagaaaccngggcgacgcccctgagatcgtagtctatggtgcatccagattcggcgaagggtcgggtcccatccgaggttcagtggcagtgcatcgtagggactagtactacgtctcgtaccaactatcagtcacgtccgtgcacgtcctagtaagttatttagacttaatttactacgtgtacaatgttattatacgtaccctaggtcgtacgtcggacgtacgggactagggtagaacgtccaaacgtacgtcggtgtactcgcctactacttcgtcgttactacctcgttcccgtcccgtaacg

SEQ ID NO: 214668 - DNA, 527 bp, Homo sapiens
  misc_feature: GYAE6OF01B3WUM.1.34.D01.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggtgcagcagaaaccngggcgagcccctnagatcgtagtctatggtgcatccagattgcaagggtgggtcccagtcaggttcaggtgcagtgcagtcgtgggacagattacactctcactatcagcagcctgcagtcctgaatntttgactaagtttattactagttacaatagttaatagttaacgtaccccttaggtggtaccggttcggaccggaggggacccaaaggggtcgaaacgttcccgaaaccggtaacttggacggtctcggaaccg

SEQ ID NO: 214669 - DNA, 553 bp, Homo sapiens
  misc_feature: GYAE6OF01A8BSE.1.34.D01.1.454.CMB.1.raw
  modified_base (280)..(280): a, c, t, g, unknown or other
  misc_feature (280)..(280): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaccagggcgacgcccctnagatcgtagtctagtggtgcatccagattgcgtaagggtcgggtcccagtccgaggttcaggtggcagtgcatcgtgggacagtacttacactctacactatcacgcacgcctgccagcctagaagtnttttagacttaatttatacgtagtactaaatagttaacttagtaccgttaccccgttaggtcggtaccgttccgggaccgtagggggacctaaggggtacggaacgtacccgaaaccggtacgttgggtacggtcgtcggaaccc

SEQ ID NO: 214670 - DNA, 658 bp, Homo sapiens
  misc_feature: GYAE6OF01EQLYO.1.34.D01.1.454.CMB.1.raw
  modified_base (259)..(259): a, c, t, g, unknown or other
  misc_feature (259)..(259): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttncagcaagaaaccgaggggaccgacgccccgtagagtagtcgtagtctagtggtcgacatccagtagtgacgaagggttcggacctagtcgtaggttcaggtcggcaggtgactagtcggtacggaacagttaacttaccaccttcgtactaacttanaccgaggaccacgtccgcgaccgacgtacctaaggtaacgttttagttttcgaactttaaagttttaccttaagccgttaactaaaccgttaagtttaacgttaaacgttaacccgttaaccccggtaggttacccgggtaaacgggtttcccgggaacccggaagggggtaacccgtaagggttaacgggaaaccgttaaccggaaacccgttaacggtggtacggtaccgtcgtaacccg

SEQ ID NO: 214671 - DNA, 560 bp, Homo sapiens
  misc_feature: GYAE6OF01EL0BU.1.34.D01.1.454.CMB.1.raw
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagacaagaaaccgngggcgacgcccctnagatcgtagtctagtggtgcatccagattgcgaaggggtcgggtcccagtccgtaggttcaggtggacagtgctagtcgtagggacagtacttacactctactactatcagcacgcctgacacgtcctagaagttattttagacttaatttacttactgtaactaatagttaattacgtaaccgtacccgtaggttcggtaaccggttcgggaccgtagggggactaaggggtacgaacgtaccgaaccgtaacgttggacggtctgtacccg

SEQ ID NO: 214672 - DNA, 650 bp, Homo sapiens
  misc_feature: GYAE6OF01A65I2.1.34.D01.1.454.CMB.1.raw
  modified_base (201)..(201): a, c, t, g, unknown or other
  misc_feature (201)..(201): n is a, c, g, or t
  modified_base (344)..(344): a, c, t, g, unknown or other
  misc_feature (344)..(344): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgctatctattgganacagagtcaccatcacgttggccgggcgacgtcaggccatcgagtcgtatttcctttagccgttggttcgactagaccgaagaaacccggagggccgaccggcccctagaacgtacgttccggttagttccttaggtgggtcncgtaactaccgagtagttcggacggtaacggggtcgggtacccctattcccgggagtttacgaggttcggactaggtcgcctagtccggtagggaactagtacctactacgtcctacgtactaacgtcacggtactacggcctagcgaccgtacttaggaaagtttcgtttacgaacttttaagtttacttaccgtagttaacctaagttaggttaacttacgtaacccgttcccgtagtcgggtaaccgtccggaacgtacggggtacagggtacgaacgtacgacgtacgtgtacgcctggacc

SEQ ID NO: 214673 - DNA, 741 bp, Homo sapiens
  misc_feature: GYAE6OF01ES29C.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctattggagacagagtcaccatcacgttgccgggcagtcaggccatcgagtcgtatttctttagccttggttcgcagacaacggaaaccgaggggccgaccgtcccctacgagtactccggtagttctaagttcggtgactactccgaagtacgttcggacgtaacggggttccgggtacccctaagttcccggtaggttccgaagggttcgggactaggttcgactacgtcggtacggggaacctaaggtacttaaccgtaccttccgtaactaacttacgtcgaacgtaccgacgtacccgtgacccgacgtacccgttaggtaaacgtttacgttttaacgaacttttaaagttttaaccgttacgtacgttaacctaaagttaacgtttaacttaaccgttaaccggttaacccccgtttaggggtaccgggttaacccgggtttaccgggaaacccgggacgggggtaaacccgtaaacggggttacggtaaaccggtaccggttaaaccgggaacgtttgggtacggtccgttaaccggacccg

SEQ ID NO: 214674 - DNA, 613 bp, Homo sapiens
  misc_feature: GYAE6OF01BQEER.1.34.D01.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccggcgagtcaggccatcagcgattcttagcctggttgcagcaagaaaccgagggcgacgcccctnagactcgtagtctatggtgcatccagtattgcaagggtgggtcccatccgaggttcaggtggcagtgcagtcgtgggacagacttacacttctactactatcagcacgcctgacacgtcctagtaacgttattttacgacttaaattttattaaccgttagttaacctaaacgttaggttaactttaacgttaacccgttaaacccccgttacgggttacgggttaacccgggtttaccggggacccggtaaagggggaacccgtaaaggggttacgggtaaacgttaccgtaaaacccggtaacgttaggtacgggttcctagggtaccc

SEQ ID NO: 214675 - DNA, 769 bp, Homo sapiens
  misc_feature: GYAE6OF01DPEN1.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtctccatccctccctgtctgcatctattggagacagacgtcaccatcacgttcggcccgggcgacgtcgacggccatcgagcgtatttctttacgccgttggttcgcgagacaacggaaaccggaggggaccgaccgcccccgtacgacgtacgtccggtagtctagtggtcgacctactccgagtacgttacggacgtaacgggggttccgggtaccctacgttcccgtaggttacgtaggtcggacgtaggtcgtacgtacgttccggtagggaaccgtaggtaactttaaccgtacctttaccgtaactaaacgttacgtacgaacgtaccgaaccggtccctacggacccgtacgtacccggttaaggtaaacggtttagtttttacggaacttttaaagtttttaacgttaccgttaacgttaaccgttaaacgtttacgtttaaacttttaccgtaaccccggtttaaccccggttaacgggtaccgggttaccgggttaccgggaacccgggtaacggggtaaacggtaacggggtaacggtaaccgtaacccggtaaaccggttaacggttggaccggtccgtcggtaacccg

SEQ ID NO: 214676 - DNA, 625 bp, Homo sapiens
  misc_feature: GYAE6OF01CU0OD.1.34.D01.1.454.CMB.1.raw
  modified_base (102)..(102): a, c, t, g, unknown or other
  misc_feature (102)..(102): n is a, c, g, or t
  modified_base (127)..(127): a, c, t, g, unknown or other
  misc_feature (127)..(127): n is a, c, g, or t
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (481)..(481): a, c, t, g, unknown or other
  misc_feature (481)..(481): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctntggctcccaggtaccagctgtgacatccaattgacccagtctccatcctcctgtctgcatctattggagacagagtcacatcacttgccgggnagtcaggcatcagcgtattcttagcctggtncagcaagaaccngggcacgccctnagtatcgtagtctagtggtcgacatccaagtacttcggacgtaaacggggttcgggtacccctagtcccgtaaggttccgaaggttcggctagtcgactagtcgtagggacagtacttaccgacttcgtactaactatcacgactacgccttaggaccagtaccctagtaacgtttattttacgactttaaatttaacttacgttntaacctaagttacgtttaacttacgtaaccggttaaccccgttacgggttacgtaccggtttacgggacccggtaaggggtaaccctaaagggttcgaaacgttacccgtaaacggtacgttagggtcggaccgttggaaaccc

SEQ ID NO: 214677 - DNA, 824 bp, Homo sapiens
  misc_feature: GYAE6OF01ACLAE.1.34.D01.1.454.CMB.1.raw
  modified_base (198)..(198): a, c, t, g, unknown or other
  misc_feature (198)..(198): n is a, c, g, or t
tcagacgagtgcgtcacgaccggtgctcgatttagatcgtctgtgttgggtttggggagtcagaccctgtcaggacacagcatggacatgagggtccccgctcagctcctgggctcctgctgctctggctccaggtaccagctgtgacatccaattcgacccagtctccatccctccctgtctgacattctattgganacagagtcaccattcacttcggaccgggcgtaagttccaggccaagtcgagtcgtaatttcgtttacgccgttggttcgctaacggacaacggaaaccgtggggaccgaacgtcccccgtagaacgtacgttaccggttaacggttccttaaggtcgggttacactaaccgttaccgtaaggtagtttacggaccggtaacgggggttaccgggttcccccaagtttcccgaagggtttccgtaaggttccgggacttacggttacggtacctacggttaccgtacggggaaccctaaggttaccttaacccgacgttaccgtaccgtaacttaccgtacgaacggtctaaccgtaccgtcggtaacccgacgttaacccgttaggtaacgttttacgtttttaacgggaacctttttaagttttaaacccgttcgttaacggttaacctaaacggttaccgttttaaacgttaacccgttaacccggttaaccccggttaggttaaccccggggttaccgggtttacccggaacccggggttaaacggggaccttaaacggggttaccggtaaaaccgtttcccggaaacccggttaacgttgggtaccgtccgtaacgtacccg

SEQ ID NO: 214678 - DNA, 752 bp, Homo sapiens
  misc_feature: GYAE6OF01EJXPN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtgggctcctgctgctcgtggcctcccgaggtaccagctgtgactactacctaattcgacccagtcctaccacttccctccctgtctgctatctagtggagacagactaccacctatcctacgttcgggcccgggtacgtacgtacgacgggtcctacgtaccgacggtcgttacttttccgtttacggtccggttgggttacgaccgtaagaccgaaaacggaaaccggacggggacccgaaccccgtccccctagaacggtacgttaccggtaaggtttacctaggtcgggtacgtacctacgtacccgtaagtacgttacggaacgggtaacggggttccgggtaccctacgtccggtaggttcgaggtcggtactaggttcgacttacggtacggtacgggtaacagttaacttacctacttcacctaccagtacacgcgtacgtccgtacgacacgtctaaggtaactttagtttacgacttaacgtttactacgttacgtaaccaaccggttacgaaccctaggtttacccgttaccggtaccgtaccgggttaccgaaccgggaaaccggtaacgtaaacgggaaaccggaaaaccgtaacggtacggtcggtacgacctcggaacctacgtacg

SEQ ID NO: 214679 - DNA, 558 bp, Homo sapiens
  misc_feature: GYAE6OF01A2JA6.1.34.D01.1.454.CMB.1.raw
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaccagggcgagcccctnagatcgtagtctatggtgcatccagattgcaagggtcgggtcccagtccaggttcagtggcagtgcatcgtgggacagattacactctcactatcagcagcctgcagcctagaagttatttcgacttaatttactactagtacaatagttacttacgttaccgtaccccgtaggttccgggtaccggtttcgggacccgtaaggggggtaaccctaagggggttacggaaacgttacccgaaaccggtaacttgggtacggtccgttcggtaaccccg

SEQ ID NO: 214680 - DNA, 838 bp, Homo sapiens
  misc_feature: GYAE6OF01A3U6E.1.34.D01.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccacctccctctntctnactactacttgtaggacacgagactaccactactactacgtccggccgggacgtacgtacggaccgacctactacgacggacgtttaccttttacgtttcgtccggttggttcgaccgtagaccgaaaaccggaaccgggacgggaccgaccccgtccccgtaagaacgttacgttacgttaacgttacttaggttcgggtacgaccttaccgtaccgtaaagttagttaccggaacggttaacgggggggttcccccggtaccttacccggtaaccgggttacgggtttaccggaaggggttccgacggttaaggtccgtaaacgtccgttaggggtaccgaacgttaacgttaacctactaccgttacctacctaacttacgacgacgcgacccgtcgtcgacgtaccgtccgaagttaagtttacgtttacgtaatttttaacgttttaacctacgttaccgtaacttaaccgttaagtttaacgttaaccgttaaccccggtttaacccgttacgggtaacccggggtttaccggtaccccgggaaccgggggtaaaccgggtaaccggttaacggggttaaacggtaacccgtaacccggtaaaaacccggttcggtagggttcccgtaaccggtacccgtaacccg

SEQ ID NO: 214681 - DNA, 849 bp, Homo sapiens
  misc_feature: GYAE6OF01AOCNM.1.34.D01.1.454.CMB.1.raw
tcagacgagtgcgtcacgaccggtgctcgatttagatcgtctgtgttgggtttgggggtaggtcgagaccctgtcaggacacagcatggacatgagggtccccgcgtcagcctccgtggggctcctgctgctctggctcccaggtaccagctgtgacatccaattcgacccagtctccatccctccctgtctgacatctagttggagacagacgtcaccatctacgttcggccgggacgagtcaacggccagttccagacgtacttctttacggccttgggtttcgaccgtagaccgtaacggaaaaccgcggggtaccggaccggtccccccgtacgaaggtacgttaccgggttagtaccgttaacggttgggtacgtactaacgttccccgaaggtacgtttcggaaccggtaacgggggttcccgggtacccctaacgttacccgggtacggtttaccgacgggttacgggaccggtacgttaccggtaccgttacgttaccgggtagggggaacctaaacgttacgtttaaaccctacccgttaccgttaacctaaaccgtttactaccggggtaacgtaccgttaacccggtccccgtttaggaaccgtaaccgggttacccgtaagggttaaaccgtttacgtttttaccgaacctttaaacggtttttaactttacccggttaacgtactaaaccggttaatttaacgtttacgtaacccggtttacccctagggttacgggtacccgtttacccggggacgtaaacgggggtaaccctaaacggggttagggaaacctttcccaaacccgggttaagtttgggcggttaccgtgtaaccc

SEQ ID NO: 214682 - DNA, 738 bp, Homo sapiens
  misc_feature: GYAE6OF01A47YC.1.34.D01.1.454.CMB.1.raw
  modified_base (199)..(199): a, c, t, g, unknown or other
  misc_feature (199)..(199): n is a, c, g, or t
  modified_base (350)..(350): a, c, t, g, unknown or other
  misc_feature (350)..(350): n is a, c, g, or t
tcagacgagtgcgtcacgaccggtgctcgatttagatcgtctgtgttgggtttgggggagtcagaccctgtcaggaaacagcatggacatgagggtcccccgctcagctcctggggctcctgctgctctggctcccaggtaccagctgtgacatccaattgacccagtctccatccctccctgtctgcatctattgganacagacgtcaccatcacgttcggccggcgagtcgaggccagtcagtcgtatttcgtttacgccgttggttcgacgaggaccaacggaaaacccgacggggaccaccgcccctagaaggtactcggtagtctagtggtcgactatccaagtnttaggacggtaacgggtccggtacccagtaccgtaggttacaggtcggactaggttcgacgtagttaccggacggggaactaacggttaactttaacccgacctttacctaacccgtacgttaacgtacccgaaacgggtccctaacgggtccccgtacggtaccgaacccggttaccgttaagggtaaacgtttttaacgttttacggtaaccttttaaagtttttaccctttaacgttaccgttaaccgtaaacgtttacgtttaactttaaacccgttaccggttaaccccgttacgggtacgggttaccggtaccgggaccggtaacgggtaacgtacgggtacgtaacgttacccgaacgtacgtcggacgctcggaccgtac

SEQ ID NO: 214683 - DNA, 719 bp, Homo sapiens
  misc_feature: GYAE6OF01ETX57.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatcctccctgtctgcatctattggagacagagtcaccatcacttggccgggcagtcaggccatccagcgtactttctttacgccttggttcgctagacgaacgaaaccgaggggccgacgcccctagagtacgtcggtagtctagtggtgacataccagtatcggacgaagggttccgggtacccagtccgtaggttcgaggttcggctagtcgactacgtcgtacgggaacaggttaacttacctacgttcctaaccgtaacttacgtaccgaacggactaacggtcccttaggacccgtacgtacccgttaagggttaaacgtttacgttttcgaaacccgttttaaatttttaaccgttacgtacgtttaaccgaaaacgttacgtttaaacgtttacgttaaccccggttaaaccccgtttagggttaaccgggttaaccgggttaccccgggaccggttaaggggaacccggttaaagggttacgggtaaaccggttaacccgaaacccggttaggtcgggttacggacgtcgtaaacccg

SEQ ID NO: 214684 - DNA, 556 bp, Homo sapiens
  misc_feature: GYAE6OF01BKCFZ.1.34.D01.1.454.CMB.1.raw
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattcttagctggtgcagcagaaaccagggcagcccctgagatcgtagtctagtggngcatccagtattgacaagggtcgggtaccccagtcccgtaggttcaggttgggacaggtcgactagtcgtagggactagtaacttacactctacactatcagcagcctagccgagtcctagtaagttatttcgaactaagttttactactagtaccaaattacgttaattacgtaacgttaaccccgtagttacgaccgttcggaccgtaagggaccgtaaaggtcggaaagtacgaaaccgtaagttggtacgcgtggacc

SEQ ID NO: 214685 - DNA, 667 bp, Homo sapiens
  misc_feature: GYAE6OF01CTX7F.1.34.D01.1.454.CMB.1.raw
  modified_base (469)..(469): a, c, t, g, unknown or other
  misc_feature (469)..(469): n is a, c, g, or t
  modified_base (488)..(488): a, c, t, g, unknown or other
  misc_feature (488)..(488): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacataccaattcgacccagtctccatcctccctgtctgcatctagtggagacagagtcaccatcacgttggccgggcgagtcaggccagtcgagcgtattcgttagcgttggtagcgagacaacgaaccgagggcgacgcccgtacagtactacgtagtcgtagtcggtcgactacgtaccgagtacgttacggacggtaacggggtccgggtacccacgtcggtacggtcgtaggtcgcgtaggtcgacgtagtcggtaggacgtagttactaacgcttacctacgtactacgacgtagaccgtagtccgtcggaccngtaccgtaaggtaacgttnttttaacgtactttaaagtttacgttaacgttacgtaaccttaagttaacgttaacgttaaccgttaaccggttaacccgttacgggtacgggttaccgttacccggggacggtaacggggaaccgttaggggaaccgtaacggtaccgtaaacggtacgtaggtcgtacgtcgtaacc

SEQ ID NO: 214686 - DNA, 827 bp, Homo sapiens
  misc_feature: GYAE6OF01EQ1FS.1.34.D01.1.454.CMB.1.raw
tcagacgagtgcgtcacgaccggtgctcgatttagatcgtctgtggttgggtttgggagtcaggccatcagcgattctttagcctggttgcagcagaaaccgagggcgacgcccctcagatcgtagtctatggtgcatccagattgcgaagggtcggggtcccatccgaggttcagtggcagtgcatcgtgggacagtacttacactctacaactatcagcagtcctgactacgtcctaggtaagttattttagacttaaattttataccgtggtacaaacgtagttaatttaacaaccggttaaccccttaagggtcggtaaccgttcccgggaccggtaacggggggtaaaccctaaaggggtacgggtaaaccgtaacccgtaaaaccccggtaaacgttcgggtacgggtaccgttacggtaccccgaaaacccgttaattcccggtttacggtttacccgttaacccgtttaaccctttaccccggttaaccccccgggtaaccctaaaaccggttttccccgttaaaacgggaaaccccccggtacggttaaaccccctttacccggggttcccgtttaacgggggaaacccgggtccggggggttaaccccggttaacccgggggtaacccgaaaaccggggtccggtaaccccgtaaagggtttaaaccgggtactaccgtagtacgtagacgtacgtacgacgtacgtacgtacgtacgtcgacgtacgtacgtacgtagtactacgtacgtacgtcgtcgacgtacgacgtacgtcgtacgtacgtactacgtacactcgacgacgtacgagcgtcg

SEQ ID NO: 214687 - DNA, 775 bp, Homo sapiens
  misc_feature: GYAE6OF01DMYCR.1.34.D01.1.454.CMB.1.raw
  modified_base (173)..(173): a, c, t, g, unknown or other
  misc_feature (173)..(173): n is a, c, g, or t
  modified_base (249)..(249): a, c, t, g, unknown or other
  misc_feature (249)..(249): n is a, c, g, or t
tcagacgagtgcgtcacgaccggtgctcgatttagatcgtctgtggttgggttgggcatggacatgagggtccccgctcagctcctggggctcctgctgctctggctcccaggtaccagctgtgacatccaattgacccagtctccattcctcctgtctgcatctagttgganacagacgtcacatcacttggccgggcgagtcaggccatcgagcgtattcttagccttggtgcagacaagaaaccgngggcacgcccctgagtacttcgtagttctagtggtacaccgtacttaccgagtacgttcggaccggtaacggggttccgggtaccccctagtacccggtagggttacccgtaagggttcggtaacgtacggttacgaccttaacgttcggtaacgggtaacgtaaggttaacctttaaccgacctttccgtacctaacgttagtacctaagtcccgtacgtaccggttagaccgtacggtccttaaggtaacgtttagtttacgtaacctttaaacgttttacgttaccgtagttaaccgtaaacttaaggtttaacctttacgttaacccggtttaacccctaagggttaccggttaacgggtttacccggaaccgggttaaccgggtaaccgtaacggggtaacggtaaaccgttacccggaaaacccggttaggttccgggtaggacccgtttaggacccgttaaccgttacttcgggtttaccttacccggttattacccgttccccgtttccccggtaacc

SEQ ID NO: 214688 - DNA, 604 bp, Homo sapiens
  misc_feature: GYAE6OF01AMJ43.1.34.D01.1.454.CMB.1.raw
  modified_base (196)..(196): a, c, t, g, unknown or other
  misc_feature (196)..(196): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (434)..(434): a, c, t, g, unknown or other
  misc_feature (434)..(434): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttggccgggcagtcaggccatcagcgtattcttagcctggtgcagcagaaccngggcacgcccctnagatcgtagtctagtggtcgcatccagtacttcgacgtaagggtcgggtcccagtccgaggttccaggtcggacagtgctagtcgtacgggactaggtacttacgacttctactactatcgagctacgccgtagccacgtacctaggtaaacgttnttttacgaacgttaacttttaacttaccgtagttaccaacttagttaattacgtaaccgttaccccgtaggttaccggtaccggtttccgggaccggtaagggggaacccttaaaggggtccggtaaacgtacccggtaaaacccgtacggttggtacgccgttgacccg

SEQ ID NO: 214689 - DNA, 537 bp, Homo sapiens
  misc_feature: GYAE6OF01CA7DQ.1.34.D01.1.454.CMB.1.raw
  modified_base (285)..(285): a, c, t, g, unknown or other
  misc_feature (285)..(285): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcagaaaccgagggcgacgcccctnagatcgtagtctatggtgcatccagtattgacgaagggtcgggtcccagtcccgaggttcaggtggcagtgctagtcgtagggacagtattacactctacactatcagcagcctgacagcctagaagttntttgactaatttatactgtacaacgtattacttatacgtacccgtaggtcggtaccgtcggacgtaaggggaacctaagggtacgaacgtaccgtaaccggtaacttggtaggctggtaccc

SEQ ID NO: 214690 - DNA, 683 bp, Homo sapiens
  misc_feature: GYAE6OF01CXW39.1.34.D01.1.454.CMB.1.raw
  modified_base (300)..(300): a, c, t, g, unknown or other
  misc_feature (300)..(300): n is a, c, g, or t
  modified_base (522)..(522): a, c, t, g, unknown or other
  misc_feature (522)..(522): n is a, c, g, or t
tcagacgagtgcgtcacgaccggtgctcgatttagatcgtctgtgttgggtttgggggagtcagaccctgtcaggacacagcatggacatggacgggtcccccgctcagctccgtggggctcctgctgctctggctcccaggtaccagctgtgacactaccaattcgacccagtcctccatccctccctgtctgcatctagtggagacagacgtcacctatcgacgttcggccgggtcgagtcgacggccatcgagcgtatttcgtttacgccgttggtgaccagacgaacggaaaccgngggccgacgccccgtacgagtacgtcgtaagtcttaagtggtcgactacgtaccgaagtagttacggacggtaacggggttccgggtacccacggttacccgtaacggttcgaacggttcggacgtaggttcgacgtacgttacggtagggactaggtaactttaccaccgttactacgaactactcgacgactacgctgacctacgtctaggttaacgttnttttacgaatttaactttaactacgttagtaacctaattagtttaactacgttacccgtaacccttagggaccggtacccgggttacggaccgggaagggtaacccggtaaggtacggaaacctaccggtaaaccgtacggttggaccggtcgtcgaaccg

SEQ ID NO: 214691 - DNA, 394 bp, Homo sapiens
  misc_feature: GYAE6OF01AMAMN.1.34.D01.1.454.CMB.1.raw
  modified_base (360)..(360): a, c, t, g, unknown or other
  misc_feature (360)..(360): n is a, c, g, or t
  modified_base (385)..(394): a, c, t, g, unknown or other
  misc_feature (385)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtggggtcccatccaggttcagtggcagtgcatctggggacagattacactctcactatcagcagcctgcagcctgaagtattttgactaatttattactgtcaacagtattatacgtacccctagtggacgttcggccagggggaccaggtggaatcacgaatgtggctgcacatctgtcttcatcttcccgcatctgaacgcactcgtcnaggcggctggcaaggcgcagtacgnnnnnnnnnn

SEQ ID NO: 214692 - DNA, 527 bp, Homo sapiens
  misc_feature: GYAE6OF01CCAM6.1.34.D01.1.454.CMB.1.raw
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (350)..(350): a, c, t, g, unknown or other
  misc_feature (350)..(350): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcagcgattcttagctggtncagcagaaccngggcgacgcccctnagtatcgtagtctagtggtgctatccagtaattcgacgtaagggtcgggtccatcccgaggtcaggtgcagtnctagtcgtgggactagtactacacgtctacactagtcagcagctgcngctgaacgtntttcgattaatttactactgtaacctaatagttattaactacgttacccgtagtcggtaacgttccgggacaaggggactagggacgtaacgtaccgaaccgtagagtcgcgttcgaacg

SEQ ID NO: 214693 - DNA, 523 bp, Homo sapiens
  misc_feature: GYAE6OF01A5TG4.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgacgcccctnagatcgtagtctagtggtgcatccagtattgcaagggtcgggtcccagtccaggttcaggtggcagtgctatcgtagggacagtattacactctacactatcagcagcctgcagcctagaagtatttgactaatttatactgtacaactatactataccgtacccgtagtacggtaccgttcggaccgtaaggggacctaagggtagaaacgtaccgaaacgtacgtggtcggcgtgacccg

SEQ ID NO: 214694 - DNA, 707 bp, Homo sapiens
  misc_feature: GYAE6OF01CNIT8.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatcctccctgtctgcatctagttggagacagacgtccaaccatctacgttcggccgggcgagtcaggccatccagcgtattctttacgccgttggttgacagcgaacgaaaccgagggccgacgcccctcgacgactacgtagtctagtggtcgctacgtccgagtattgacgtaagggtcgggtacccagtccgtacggttcgacggttcggacgtagtcgacgtagttcggtacgggaactaaggtaacttactacctccttaaccgactaacgtcgaacgcgtacgtccgtacgccgaacgtccgtaaggtaacgtttaagttttacgtaacttttaaacgttttaacttaacgttacgttaacctaaacgttacgtttaacgttaccgttaaccggttaaccccgttaggggttaccggtaaccggtttaccggggaacccgggtaacggggtaaccgtaaggggttaaccggtaaacggttacccgtaaacccgggttaagttacgggtccggtcgttaccggtaacccg

SEQ ID NO: 214695 - DNA, 506 bp, Homo sapiens
  misc_feature: GYAE6OF01E1MX0.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgacgcccctnagatcgtagtctatggtgcatccagattgacaggtcgggtccatccaggttcagtggcagtgcatcgtgggacagatacactctcactatcagcagcctgcagcctgagtatttgactaatttatacgtgtacaactagtattactacgtacccctagtcggtacgttcggccgtaggggactaagggtaggaacgtcgaaaccgaacttaggtcggtcgtgtacc

SEQ ID NO: 214696 - DNA, 663 bp, Homo sapiens
  misc_feature: GYAE6OF01DDT30.1.34.D01.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactcctccctgtctgcatctatgganacagagtcaccatcacgttcggccgggcagtcgaggccatcgagcgtatttacgtttacggccgttggttcgacagacgaacggaaaccgacggggccgacgccccctanacgacgtcgtagtctagtggtacgacagtaccagtacgttcgacgtaaggggttcgggtaccctacgtaccgtacggttacaggtcggacgtacggtcgtacacgtcgtacgggaactaagtacttaaccgtacgtacctacacttactcgacgcacgccgtgaccgacgtaccgtaggtaacgttgtttacgtaactttaatttacgttaacttacgttaactaaacgttaacgtttaacttaccgttaacccgttaacccgtacggtacggtaccggtaccgggaaccggtaacgggtaaccgtaagggtacggtaaacgtaccgtaaacggtacgttaggtacgcgtcgacc

SEQ ID NO: 214697 - DNA, 623 bp, Homo sapiens
  misc_feature: GYAE6OF01D6ART.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctattgganacagagtcaccatcacttgccggcgagtcaggccatcagcgtatttctttagcctggttgcagcaacgaaaccgagggcgacgcccctagacgatcgtagtctagtggtgcatccagtattgcgaaggtcgggtcccagtcctaggttcaaggtggacgagtcgcgagtcgtacgggggaacagtacttaacctactacgtacaacgttactacaacgcacgcctagcctacgtaccgtagtaacgttattttacgacttaaagttttattaaccttagtacctaaatacgttattacgttaccgttaaccccgttaagttccgggtacggttccgggaccggtaaggggtaacccggtaaagggaaccgggtaaacgttaaccccggaaaccggttaaccgtagggtacggtcgtcggtaacccg

SEQ ID NO: 214698 - DNA, 782 bp, Homo sapiens
  misc_feature: GYAE6OF01BL6Q7.1.34.D01.1.454.CMB.1.raw
  modified_base (206)..(206): a, c, t, g, unknown or other
  misc_feature (206)..(206): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggcctcctgctgctctggcctcccaggtaccagctgtgacatccaattcgacccagtcctccactccctccctgtctgcatctattgganacagagtccaccatcgacgtcggccggcgagtcaggccatcgacgcgtattcgttacgccgtaggttcgacgagaccaacgaaccgagggccgacgcccctagacgtactcgtacgtctagtgggtcgacctacgtccgaagtacgttcggacgtagggtcgggtaccctacgtaccgtacggttacgaggtcggactacggttcgaccgtaacgttccggtagggaaccgtaacgttaacgttacctaaccctaccgttaccgtaaccttacgtaccgtacgtaccgtaccgtaccgttacggtacccgtaaccggtaccttaacggtaaacgtttacgttttaccgtaaccgtttaaagttttacgttaaccgtttaacgtaaccggtaaacgttaacggtttaacgtttaacgttaaccccggttaaccccggttaacgggttaccggggttaacccggtttccgggaacccgggtaaccgggggtaaccgttaaacgggggtaaccggtttaaaccgaaccccggttaaaccggtacggttagggttaccgggtacctacccggtaaacccg

SEQ ID NO: 214699 - DNA, 713 bp, Homo sapiens
  misc_feature: GYAE6OF01DI167.1.34.D01.1.454.CMB.1.raw
  modified_base (234)..(234): a, c, t, g, unknown or other
  misc_feature (234)..(234): n is a, c, g, or t
  modified_base (341)..(341): a, c, t, g, unknown or other
  misc_feature (341)..(341): n is a, c, g, or t
  modified_base (452)..(452): a, c, t, g, unknown or other
  misc_feature (452)..(452): n is a, c, g, or t
tcagacgagtgcgtcacgaccggtgctcgatttagatcgtctgtgttgggtttgggggagtcagaccctgtcaggacacagcatggacatggacgggtccccgctcagcctccgtggggctcctgctgctctggctcccaggtaccagctgtgacatccaattcgacccagtctccatccctcctgtctgctatctatggagacagacgtcaacctatctacgttcggccgggngagtcgaggtccagtcgagtccgtatttccgtttacgccgttggttgacgagaccgaagaaaccgaggggaccgaccgacccctagagtatcgtacgtctagtggtnactagtccgtaagtacgttcgaacgggtacggggttccggtaccctagttcccgaggttcgaggtcggacgtagtcgacgtagtcgtagggaactagtacttacgcttacnctaactatcgagacgagcctagaccaggtacctaaggtaactttgttagtaacctttaagttttaacctacgtacgtaacctaacgttaacgtttaaacttacccgtaaccggttaacccccgttaggggttaaacccgggtacccgggtttaacccgggaaccgggtaaaggggggtacccttaaaagggggaccgggttaaacctaaccccggtaaaaccggtggtttaccgggaccggtttcgtacccggtaaacccg

SEQ ID NO: 214700 - DNA, 612 bp, Homo sapiens
  misc_feature: GYAE6OF01DT8TH.1.34.D01.1.454.CMB.1.raw
  modified_base (199)..(199): a, c, t, g, unknown or other
  misc_feature (199)..(199): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctccctgtctgcatctattgganacagatcaccatcacttcggccgggcgagtcaggccatcgagcgtatttcgttacgcctggttgcagcgaacgaaaccgagggcgacgcccctgaagactcgtagtcgtagtggtgacatccagtattggacgaaggggtcgggtacccagtccgtaggttcaggtcggcagtgacagtcgtaggaactagtaattaccactctacgaacttnactagacacgtcctgaccgtacgtccgtaggtaagttatttttacgaactttaaatttttacgttaacgttacgtaactaaacttagttaacttacgtaaccgttaccccgtaaggtccggtacggttccgggaaccggtaaggggaccgtaagggtaacggaacgtaaccgtaacggtaactgggtacgcgtagacccg

SEQ ID NO: 214701 - DNA, 638 bp, Homo sapiens
  misc_feature: GYAE6OF01EVN6X.1.34.D01.1.454.CMB.1.raw
  modified_base (310)..(310): a, c, t, g, unknown or other
  misc_feature (310)..(310): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccggcgagtcgacggccatcgagcgtatttctttagcctggttgcagcaagaaaccgagggccgacgcccctgagtactcgtagtctagtggtncatccgagtattcgacgtaagggtcggtacccagtccgtaggttcaggtcggactaggtcgactagtcgtagggactagtacttaccgacttctacacttatacgagtcacgcctgacacgtcctaaggaatttactttcgaactttaagttttaacttacgtagttaacctaaagttacgtttaattaacgttaacccgttaccccgttaaggttaccgggttaacccggttaccgggacccggtaaagggggtaaccgtaaagggggtacggtaaaaccggtacccgtaaacggttaacccttgggtacgtaccgtcggtaacccg

SEQ ID NO: 214702 - DNA, 613 bp, Homo sapiens
  misc_feature: GYAE6OF01A3W13.1.34.D01.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcgaggccatcagcgtattctttagcctggttgcagcaagaaaccgagggccgacgcccctnagtatcgtagtctagtggtgcatccagtattgacgtaacggggtcgggtcccagtcccgaggttccgaggtcggcaggtcgactagtccggtagggaactaggtacttacaccttcctactaactatcgagccacgcctcgcgacgtaccgtaggtaaagtttgttttacgactttaattttaacttaccgtagttaacctaaagttacgttaattaacgttaaccgttaaccccgttaggttaccgggtaccggttaccgggaccggtaggggaaccgtagggtacggaacgtaaccgaaacgtacgtggtcggtcgtggaccc

SEQ ID NO: 214703 - DNA, 845 bp, Homo sapiens
  misc_feature: GYAE6OF01BVXBG.1.34.D01.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcgagcgtattctttacgccttggttgcagacaaggaaaccgagggcgacgcccctgagtactcggtagtctagtggtgcctataccgaggtactttggaccggtaaacgggggttcggggtacccctaacgttcccggtaaggggttttaccgaacggggttcgggacccgtagggtttacggaccgtaaacggttccgggttacgggggaacctagggttaacctttaaccggtacctttacctaccgtaactaacgttccgaacgccgtaacgtcccgtcggaccgtacggtaccgttaagggtaaacgttttaacgtttttcggaaccttttaaagttttttaaccgtttaaccgttacgggttaaacccgtaaaacgtttaaacggtttttaaccgttttaacggttaaacccccgggttaaacccccgttttaaacggggtttacccggggttaaacccggggttttacccgggggaaaccccgggttaacccggggggggtaaaacccgttaaagggggggttaaccggtaaaacccgggtttaccccgtaaaaacccgggttacggtttagggtacccggggttacgtacccgggtaaaccccg

SEQ ID NO: 214704 - DNA, 707 bp, Homo sapiens
  misc_feature: GYAE6OF01D2AG9.1.34.D01.1.454.CMB.1.raw
  modified_base (102)..(102): a, c, t, g, unknown or other
  misc_feature (102)..(102): n is a, c, g, or t
  modified_base (200)..(200): a, c, t, g, unknown or other
  misc_feature (200)..(200): n is a, c, g, or t
  modified_base (697)..(697): a, c, t, g, unknown or other
  misc_feature (697)..(697): n is a, c, g, or t
tcagacgagtgcgtcacgaccggtgctcgatttagatcgtctgtgttgggtttgggggagtcagaccctgtcaggacacagcatggacatgagggtccccgntcagctccgtgggctcctgctgctctggctcccaggtaccagctgtgacatccaattcgacccagtctccatccctcctgtctgctatctagttgganacagactccactatcacgttcggccgggagagtcgacggccagtcgaggtcgtactttcgtttacgccgttggtcgacacggaccgaaggaaaccggcgggaccgacccgtcccctgacgtacgtcgtagtctagttgggacactacgtaccgagttagttcggacggtacggggtccggacctacggtccgtaggttcgaggtcgacgtaggtcgacgtaggtacggtacgggtaacctaagttaccttaaccgacctttaccgtaacctaacgttaacgtaccgaacggtccgtaacggtcccgtacggaccgttaccggtaccgtttaaggtaaccgttttattttaccggaacttttaacgttttataccgtacgtaacttaaacgtttataaccgttaacgttacccgtaccggtaggttaccggtacggtaaccggcggtaacgggtacgtaagggtaccgtaacgacccggtaacgtggtggtaccggtntccgtaaccg

SEQ ID NO: 214705 - DNA, 597 bp, Homo sapiens
  misc_feature: GYAE6OF01BC950.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagagtcaccatcacttggccgggcgagtcaggccatcagcgtatttcttagcctggttgcagacaagaaaccgaggggaccgacgccccctagagtagtcgtagtctagtggtcgctatccagtattgacgaagggtcgggtcccagtccgtaaggttcaggtcggcgtagtcgctagtcgtagggactagtactacgactctacattactacagcacgcctgccagaccgttagtaaagttctttaggtacttaagtttacttactacgtactaaatagttaacttactaccgttaccctacggttacggtaccggttccgggacgtaaggggaacccgtaagggtacggtaacgtaaccgtaaaccggtaacgtggtacggtactggtaacccg

SEQ ID NO: 214706 - DNA, 792 bp, Homo sapiens
  misc_feature: GYAE6OF01ESWUL.1.34.D01.1.454.CMB.1.raw
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagagtcaccatcacgttcggccgggcgagtcgacggccatcgagtcgtatttctttacgccgttggttcgacgagacgaacggaaaacccggnggggaccgacgccccctacgaacgtacgttacggtacgtctagtgggtcactaacgtccagtagttacggacgtaacggggtccgggtaccctagtacccggtaggtttcgaggttcggacgtaggtcgactagttcggtacgggaactagttaacttaaccaccgttctacctaacttactacgaacggtacctaccggtcccgtagaccgtaaccggtaccgttaaggtaaacgttttacgtttttacggaactttttaaacgtttttaaccgttaacgttacggttaaacctaaacgtttaacgtttaaacctttaaccggttaaaccccggttaaccccgggttaacggtttacccggggttaaacccgggtttcccggggaaacccgggtaacggggggtaaacccggttaaaggggtaacccgggtaaaaccgttaaacccggtaaacccgggttaagttaccggggtaccggtcgttaaccggtaaccccg

SEQ ID NO: 214707 - DNA, 745 bp, Homo sapiens
  misc_feature: GYAE6OF01C1IHD.1.34.D01.1.454.CMB.1.raw
  modified_base (103)..(103): a, c, t, g, unknown or other
  misc_feature (103)..(103): n is a, c, g, or t
tcagacgagtgcgtcacgaccggtgctcgatttagatcgtctgtgttggggtttgggggagtcagaccctgtcaggacacagcatggacatgagggtccccgntcagctccgtggggcctcctgctgctcgtggcctcccgaggtaccagctgtgactataccaattcgaccctagtcctccatccctccctgtctgctattctagtggagacgagacgtacacctatccgtacggttcggccgggacgacgtcacggccatcgagtcgtactttacgtttacggtccgttggttacgacgacgacaacggaaccggacgggccgaccgtacccctagacgtacgtacggtacgttacgtagtcggtacgaccgtacgtaccgtaaggtacgttacgggacggtacgggggtaccgggtacccaaggttaccggtaggtacgtacggtcggtactaggtacgcgttacggtacggtaacggacgtaacgttacctaaccaccttccgtaactacttaacgtaccgacgaaccgtcggtaccctacggaccgtaacggttactaacgttaagtttacgtttactaacgtttaatttacgttacgacgtaactaaacgttgttaaccgttaccgtaaccgttacccgttaaggtccgggtaaccggtaccggaaccgggtaaggtaacggtagggttaaacgaacttacccgggaaacgttacggtacgcggtccgtacgtaccccg

SEQ ID NO: 214708 - DNA, 746 bp, Homo sapiens
  misc_feature: GYAE6OF01CXTF8.1.34.D01.1.454.CMB.1.raw
  modified_base (232)..(232): a, c, t, g, unknown or other
  misc_feature (232)..(232): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattgacccagtctccatccctccctgtctgcattctattggagacagagtccacatcctacgttcggccggggngagtcacggccatcgagcgtattcttagcttggtncagcagaaccgnggcacgcccctnacgtactcgtatcgtagtcggtcgactactaccgagtaagttcggacggtaacggggtccgggtacccacgttcccgtaggttacgaggttcggcgaggtcgtactacgttcggtacgggaactacggtacttaccgacttacctactaacgtactacgaacgcctaacggtccgtacgaccgtaaccgtaccgtaacggttaaacgtttacgttttacgaaacgtttttaaactttttaaccgttacgtttaaccgtaaccgttaaaacgttacgttttaacttaaccggttaacccgggtttaaaccccgttagggtacccgggtttaccgggttacccgggtaaacccggggtaaacgggggtaaccggtttaaagggggtaaccgggtaaaaccgttacccggtaaaacccgggttaaccggttgggtaccggttacgttccggaaccccg

SEQ ID NO: 214709 - DNA, 643 bp, Homo sapiens
  misc_feature: GYAE6OF01DIW0U.1.34.D01.1.454.CMB.1.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatggagacagagtcaccatcacttgccgggnagtcaggccatcagcgtattctttagcctggttgcagcaagaaaccgagggcgacgcccctanagactcgtagtctagtggtgcatccagtagttgacgtaagggtcgggtacccagtcccgaggttcaggtggcagtgctagtcgtagggacagtacttacacttctcaactatcgagcacgcctgccagccttaggtaacgttattttcgactttaaattttacgttaacgtagtacctaaacgttagtttaacttacgttaaccggttaacccccgttagggttaccgggttaacccggtttacccgggggaacccggtaaacgggggggtaacccgtaaagggggttaccgggtaaaacggttaacccgtaaaacccgggttaacggttcgggttacgggtaccttacggaaccccg

SEQ ID NO: 214710 - DNA, 688 bp, Homo sapiens
  misc_feature: GYAE6OF01EPB7K.1.34.D01.1.454.CMB.1.raw
  modified_base (104)..(104): a, c, t, g, unknown or other
  misc_feature (104)..(104): n is a, c, g, or t
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggggagtcgagaccctgtcaggacacagcatggacatcgagggtccccgntcagctcctgggctcctgctgctctcggctcccaggtaccagctgtgacatccaattgacccagtcctccatcctccctgtctgcatctatgganacagagtcaccatcacttgccggtcgagtcaggccagtcagcgtattcttacgcctggttnccagtcacgaaaccgngggacgtacgcccctgagtacgtcgtacgtctagtggtcgacatccagtattgacgaaggtcgggtcccagtcgagttcgaggtcggacagtcgacgtacgtacggtcgggaactagttaacgttaacctaccgttcctacgtaaacctttagtaccgaagtccgtaacggtcccgttacgaccgtaacgttacccgttaaggtaacggtttaacttttcggtaacctttaaagtttttaccgttaacgttcggtaaccttaaacggtaacgtttaacttacgttaaaccggttacccccggttaggttaaccgggtacccgtttaccggggaccggtaacgggggtaacctaaggggtaacggaacgttaaccggaaacccgtacggttagtccgggtctcggtaaccccg

SEQ ID NO: 214711 - DNA, 942 bp, Homo sapiens
  misc_feature: GYAE6OF01E2JFP.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattcgacccagtcctccactccctccctgtctgcatctattggagacagagtccaccatccacgttcggccgggacgagtcacggccatcgagcgtatttcttacggtccgttggttgacagacgaacggaaacccggagggtaccgaccgcccccgtacgacgtacgttaccggtacgtacgttaggttcgggtacgtaccactaccgtaaggtacgtttacggaccggtaacggggttccggggtaccccctaagttaccccggttaacgggttaccgtacgggtagggtaccgtacgggtcggtaaccgtaacggtccgggttaacggggtaacgtaacgggtttaaacctttaaccccgtaacccgtttcccgttaacccgtaaaccttttaaccggtaaccctaacggacccgtaaacggtccccgtagtacccgtaacggttacccgtaaggtttaaacgtttacgtttttacgaaccgttttaaatttttaacggtttaccgttaacggtttaaacccgtaaaacgtttagtttaaaccgtttaaccggttaaaccccgggtttaaacccccgtttacgggggttaaaccccggggttaaacccgggtttaccccgggggtaaccccgggggttaaaacccgggggtaaacccggggttaaaagggggttaacccccgggttaaaaccggggttaaaacccccgggtaaacccccggggttttaaacgggtccgggggttttaacgggaacccccgggtttacccgtaaacccccggg

SEQ ID NO: 214712 - DNA, 396 bp, Homo sapiens
  misc_feature: GYAE6OF01BVOAS.1.34.D01.1.454.CMB.1.raw
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
  modified_base (389)..(396): a, c, t, g, unknown or other
  misc_feature (389)..(396): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcancagcctgcagcctgaagtnttttgactaatttattactgtcaacagtattatacgtacccctagtggaccgttcggccaggggaccaaggtggaagtcaacggatgngctgcacatctgtcttcactcctcccgccctcctcnccgcactcgtcgtgacggcgggctggcaaggcncatgnnnnnnnn

SEQ ID NO: 214713 - DNA, 426 bp, Homo sapiens
  misc_feature: GYAE6OF01D5NG5.1.34.D01.1.454.CMB.1.raw
  modified_base (314)..(314): a, c, t, g, unknown or other
  misc_feature (314)..(314): n is a, c, g, or t
  modified_base (394)..(395): a, c, t, g, unknown or other
  misc_feature (394)..(395): n is a, c, g, or t
  modified_base (398)..(426): a, c, t, g, unknown or other
  misc_feature (398)..(426): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttatactgtacaacagttattatagtacccctagtgtacgttcggcaggggaccaaggtggaatcaaccgatgtggntgcacatctgtcttcatcctcccgcatctgaccgcactcgtctgaggcgggtcgtggacctaaagggccacgtataggcnncgnnnnnnnnnnnnnnnnnnnnnnnnnnnnn

SEQ ID NO: 214714 - DNA, 658 bp, Homo sapiens
  misc_feature: GYAE6OF01ENZRV.1.34.D01.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtctccatcctcctgtctgcatctattgganacagagtcaccatcacgttggccggnagtcaggccatcagcgtattcttagcctaggttgcagaccgaaggaaaccgagggtccgacgcccctcgagacgtcgtacgtctagtggtgacattccagtagtcgacgagggtccgggtccctagtcccgtaggttcaggtgcgtagtcgactagtcgtacgggactaacgtacgttaacctacttacgtacccttaagtaccttcggaacgtccaccggtacctcgacgtactcccgtaaggaacttggtacggtacgttacgttaagttttactacgttagaccgtagtacttaactttagttaattaccggtttactttacccgtttaccggtaacccttacggttaacccgggacgtaaaccggggttaactaaccccggtaaggttacgggtaaatttaaacccggttaaaacgtcgggtttaaccggg

SEQ ID NO: 214715 - DNA, 504 bp, Homo sapiens
  misc_feature: GYAE6OF01CD0I7.1.34.D01.1.454.CMB.1.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttncagcaagaaaccagggcagcccctanagatcgtagtctatggtgcatcagattgcgaaggtgggtcccatccgaggtcagtgcagtgcatcgtgggacagacttacactctacactatcancancctgcagctagaagttntttgactaatttatactgtacaactatattataccgtaccctaggtcgacgttcggaccgagggacagggtacgaaagttacgaaaccgtaacgtggtacgcgtgacc

SEQ ID NO: 214716 - DNA, 549 bp, Homo sapiens
  misc_feature: GYAE6OF01EFHGJ.1.34.D01.1.454.CMB.1.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggccatcagcgtattcttagcctggttncagcaagaaaccgagggccgacgcccctnagatcgtagtctagtggtncatccagtagttcggacgaagggtcgggtacccagtccgaggttcaggtggcagtcgctatcgtagggacagtacttacactctcaactatacagcacgcctgcacgtctagtaacttatttcgacttaatttactacgtgtactaacgtattacttactaccgtaccctaggtcggtaccgttccggacggtagggaccgtaagggtacggaacgtaccgtaacgacgttcggaggtctcgacc

SEQ ID NO: 214717 - DNA, 565 bp, Homo sapiens
  misc_feature: GYAE6OF01BMHRY.1.34.D01.1.454.CMB.1.raw
  modified_base (316)..(316): a, c, t, g, unknown or other
  misc_feature (316)..(316): n is a, c, g, or t
  modified_base (440)..(440): a, c, t, g, unknown or other
  misc_feature (440)..(440): n is a, c, g, or t
tcagacgagtgcgtcacgaccggtgctcgatttagatcgtctgtgttggggtttgggggagtcagaccctgtcaggacacagcatggacatggagggtccccgctcagctccgtggggctcctgctgctctggctcccaggtaccagctgtgacatccaattgacccagtctccatcctccctgtctgcatctatggagacagagtcaccatcacgttggccggagagtcaggccatcagcgtattcgttagcctggtgcagacaagaaaccgagggcgacgcccctagagtaacgtcgtagtctaagtgggtacncgactcaagtattagacgtaagggtcgggtccagtccgtaggtcaaggtgacaggtgcagtcgtaggacagtactaccgactctacaactatacagcacgaccgtgacacgtactagaacgttntttacgaacttaagtttacttacagttacaaacgtatttaagtacgtaaccgtaccctaggtcggtaaccgttcgaacggagggaacctagggagtaacgtacgaacgtagtggacgctcggaac

SEQ ID NO: 214718 - DNA, 793 bp, Homo sapiens
  misc_feature: GYAE6OF01A0WOU.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtcctccactccctccctgtctgctatctagttggagacagagtccaaccatcacgttcggccgggcgagtcaggccatcgagcgtatttcttagccgttggttcgcagacaacggaaaccggaggggccgaccgccccctagaacggtacgttcggttacgtccgttaagttcgggtacacctacgttaccgaagtacgtttcggacgtaacgggggtccgggtaccctacggttcccgtaaggttccgtacggtcggaccgtaggtcgtacgacgttacggacgggtactagtacttaccgtacctcgttacacttacacgacgactaccgtccgtacgcctacgtcgttaagtaacgtttagtttaaccgtaacttttaaacgtttactttaaccgtacgttaaccgtaaacgtttacgtttaacgtttaacccgttaacccggttttaccccggttaagggtttaacccggggttaacccgggttaccccgggggtaaaccgggtaaacccggggggttaaaccccggttaaagggggttaaacccggggtaaacccgttttaaacccggaaacccgggtttaaccgttacgggtaaccggttacccgtaacggtaaccccc

SEQ ID NO: 214719 - DNA, 582 bp, Homo sapiens
  misc_feature: GYAE6OF01CX7TX.1.34.D01.1.454.CMB.1.raw
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccgtggttgcagcaagaaaccgngggccgacgcccctacagactcgtagtctagtggtncatccagattgacgaaggtcgggtcccaagtccgaggttcgaggtggctagtgacagtcgtgggacagtaacttacgactctacactatcagaccagcctgacctagcctagtaagtnttttacgacttaaacttttatacttagtaactaagtaattaacttacgtaaccgttaaccccgtaggtacggtaccggttccgggaccggaacggggttaaccgaagggtacggaacgtacccgtaaaaccggtacttggtacggtctcggtaacc

SEQ ID NO: 214720 - DNA, 561 bp, Homo sapiens
  misc_feature: GYAE6OF01BSVD5.1.34.D01.1.454.CMB.1.raw
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccgggcgagtcaggccatcagcgtattctttagcctggttgcagcaagaaaccgagggaccgacgcccctcgagactcgtagtctagtggtcgcatccagtagttgacgtaagggtcgggtacccatccgaggtttcaggttcggctagtgacagtcgtagggactagtactacacttcactactnacagacacgcctgcacgtcctaggaacttatttcgattaatttatacgttgtactaaactagttaacttactaccgtaccctaggtcggtaccgttcgggaccgtacggggacgtaacgggtagtaaacgtaccgaacgtacgtggcggctcggacc

SEQ ID NO: 214721 - DNA, 704 bp, Homo sapiens
  misc_feature: GYAE6OF01AH2ZK.1.34.D01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctctggctcccaggtaccagctgtgacatccaattcgacccagtcctccatccctcctgtctgcatctagttgganacagagtcaccatcacgttcggccgggcgagtcgacggccatcgagcgtatttcttagccgttggttcgcgagacgaacggaaaccggaggggaccgaccgtccccctagacgtactcggtagttacgtagttcgggtacgacctactaccgaggtacgttacggacggtaacgggggttccgggtcccacgtccgtaggttacgaggtcggacgtaggtcgactagtcgtagggacagtacttacaccgttcactacgtactacgagccacgcctaggcctacgtaccgtaggtaacgttagttttacgaactttaagttttaaccttagttacttaacctaacgttaagtttaacttaaccgttaacccgttaccccggttagggttaccggtaacccggggttcccgggaacccgggtaacgggggtaaccgtaaacgggggtaggtaaacccggtacccggtaaaccggttagttcgggcggtcgttccggaacccg

SEQ ID NO: 214722 - DNA, 727 bp, Homo sapiens
  misc_feature: GYAE6OF01BM4GN.1.34.D01.1.454.CMB.1.raw
  modified_base (198)..(198): a, c, t, g, unknown or other
  misc_feature (198)..(198): n is a, c, g, or t
  modified_base (440)..(440): a, c, t, g, unknown or other
  misc_feature (440)..(440): n is a, c, g, or t
tcagacgagtgcgtcacgaccggtgctcgatttagatcgtctgtgttgggtttgggggagtcagaccctgtcaggacacagcattgacatgagggtccccgctcagctcctggggctcctgctgctctggctcccaggtaccagctgtgacatccaattgacccagtctccatccctccctgtctgcatctattgganacagagtcaccatcacttggccgggcgagtcaggccatcagcgtacttcgtttagcctggttgcagcaacgaaaccgagggcgacgccccagagacgttcgtagtctagtggtagcatccgagtattggacgtaaggggtcggggttacccagttacccgtaggtttacgaggttcggaccgtaaggtcgaccgtagttcggtacgggaactagtacttaacctacttcgtactacttaacncgtagacctaacggtcctacgaccgacggtaccttaaggtaacgtttactttttacggaaacttttaaacgtttttaacgttaccgttaacggttaacctaaagtttaacgtttaactttaaccggttaacccggttaaccccggttaacgggtttaccggggtaacccgggtttacccggtaaccgggtaacggggggtaaacccggtaaaggggttaccgggtaaaaccgtaaccggttaaaccccggtaacgtttagggtacggtcccggttcggtaaaccccg

SEQ ID NO: 214723 - DNA, 561 bp, Homo sapiens
  misc_feature: GYAE6OF01EBAKC.1.34.D01.1.454.CMB.1.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaaggccatcagcgattcttagcctggtncagcagaaaccngggcgacgcccctanagatcgtagtctatggtgcactccagtattgacgaagggtcgggtccctagtccctagggttcaggtcggacgagtgctagtcgtgggacagtacttacactctcactatcagcacgcctgcacgctagtaacgtattttgacttaatttattacgtagtactaactagttacttacgtacgtacccgtaggtacggtacggttccggaccgtaagggggaccctaaggggtacgtaaacgtacccgtaaacggtaaaccttgggtcgtcgtcgtacccg

SEQ ID NO: 214724 - DNA, 658 bp, Homo sapiens
  misc_feature: GYAE6OF01CCQHH.1.34.D01.1.454.CMB.1.raw
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (323)..(323): a, c, t, g, unknown or other
  misc_feature (323)..(323): n is a, c, g, or t
tcagacgagtgcgtcacgaccggtgctcgatttagatcgtctgtggttggggtttgggggagtcagaccctgtcaggacacagcatggacatggacgggtcccccgctcagctccgtggggctcctgctgctctggctcccaggtaccagctgtgacatccaattcgacccagtctccactccctccctgtctgcatctatggagacagagtcacatcacttggccgggcagtcacggccatcagcgtattcgttacgccgttggtcncgagacaacggaaaccgngggaccaccgccctagacgatcgtatctagtcggtancatccgaagtagttacggacgttaacggggtcgggtaccccagttacccggtaaggttcgaaggtcggactagtacgccgtaagttcggtagggaactaaggtacttaactactacgttacctaactacgtacgaagaccgtagcccgtagacgaccgtactaaggtaacgttatttttaacgaactttaaatttacttacgtagtaacctaaactagtttaaccttacgttaacccgtacccgttacggtacggtaaccggttaccgggacgtaacggggaactaagggtacggaaagtacccgaaaccgtaggtaggtacgtcgtcgtacccg

SEQ ID NO: 214725 - DNA, 694 bp, Homo sapiens
  misc_feature: GYAE6OF01A2UXP.1.34.D01.1.454.CMB.1.raw
  modified_base (278)..(278): a, c, t, g, unknown or other
  misc_feature (278)..(278): n is a, c, g, or t
  modified_base (487)..(487): a, c, t, g, unknown or other
  misc_feature (487)..(487): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctagtggagacagatcaccatcacttcggccgggcgagtcaggccatcagcgtattctttagccgtggttgcagacaacgaaaccgngggcgacgcccctgagactcgtagtctagtggtcgctagtccagtatttacggacggtaacggggtccgggtaccccagttacccgtaggtttccgagggttcggactaggttagtacgtccggtaggggaactaggtaacttaccaacgttctactacttatacgagtcacgtcccgtagaccgtacggtaccgtaggtaaacgtttntttttacgaacttttaacgttttacttaaccgttacggtaaaccttaaacgttaggtttaaacttttaaccggtaaccccgttaaccccgttagggttaccgggttaccggttacgggaacccgggtaacggggtaaacccgtaaggggtacggtaaccgtaacccggaaacggtacggttacgggtacggtctacggacctaaccg

SEQ ID NO: 214726 - DNA, 627 bp, Homo sapiens
  misc_feature: GYAE6OF01DQM3L.1.34.D01.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggnagtcaggccatcagcgtattcttagcttggtgcagcaggaaaccngggcgacncccctnagactcgtagtctagtggtgcatccagattggacgtaagggtcgggtacccagtcccaggttcacggtggactaggcgactacgtcgtagggaactagtatttaacaccgttctacgtacttacttcaacgcgaacgtccctgaccgagacccgttagtaacgttagtttttacgaactttaacgttttattaaccgttaggtaacctaaccgttaaggtttaacctttacgtaaccgtttacccccgtaacgggttccggtaaccggttccgggtaccggaacggggtaacccgtaagggtacgtaacgtactaaccggtaactcggtacggccgtgtaacccg

SEQ ID NO: 214727 - DNA, 709 bp, Homo sapiens
  misc_feature: GYAE6OF01DQVVG.1.34.D01.1.454.CMB.1.raw
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgctatctagtggagacagagtcacctatccacgttcggccgggcagtcaggccatcagcgtattcgttagccttggttgcagcaagaaccgngggcgacgccctnagactcgtagtctagtggtncactccagtattgacgtaacgggtcgggtacccagttcccgaggttcgaggtggcgtaggtcgtacgtagttcgaggggaactaagtaaccttaccacttcctactaacttacgtacgacgacgtacgtccgtgaccgtaacggccgttaaggtaacggttttagttttacggtaacttttaaagtttttaacgtttaccgttaacggttaacctaaacgtttagtttaaaccgttttaacggtaaacccggtttacccccgttaggggtacccgggttaaccgggtttacccgggaaacccgggtacgggggtaaacccgttaaagggggtaccggtaaaacccggtacccggtaaaaccggttaccggttaggggtaccggtaccgtacggtaaccc

SEQ ID NO: 214728 - DNA, 594 bp, Homo sapiens
  misc_feature: GYAE6OF01D2UBF.1.34.D01.1.454.CMB.1.raw
  modified_base (350)..(350): a, c, t, g, unknown or other
  misc_feature (350)..(350): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatggagacagagtcaccatcacttgccgggcgagtcaggccatcagcgattctttagccttggttgcagacaacgaaaccgagggcgacgcccctcgagtatcggtagtctagtggtgcatccagtattgacgtaagggtcgggtacccagtccgaggttnaggtggcagtgactagtcgtggactagtattacactctacaactatacagcacgtcctgccagtcctagtaacgttatttacgacttaagttttactacgtgtaactaacttagttaacttacgtaccgtaacccgttacggtacggtaccggttaccgggaccggtaacgggggtaaccgtaaagggtacgggtaaaccgtacccgtaaaccgtaacggttggacggtccgtcggtaaccccg

SEQ ID NO: 214729 - DNA, 399 bp, Homo sapiens
  misc_feature: GYAE6OF01E2S9O.1.34.D01.1.454.CMB.1.raw
  modified_base (353)..(353): a, c, t, g, unknown or other
  misc_feature (353)..(353): n is a, c, g, or t
  modified_base (379)..(379): a, c, t, g, unknown or other
  misc_feature (379)..(379): n is a, c, g, or t
  modified_base (386)..(399): a, c, t, g, unknown or other
  misc_feature (386)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagagtattttgactaattttatactgtacaacagtattatacgtacccctagtggacgttcggccaggggaccaaggtggaatcaaccgaactggtgctgcaccatctgtctcatctcccgcatctgaaccnctcgctgacgcggcgtggcaaggtcnctatcgnnnnnnnnnnnnnn

SEQ ID NO: 214730 - DNA, 576 bp, Homo sapiens
  misc_feature: GYAE6OF01BCS88.1.34.D01.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccggcgagtcaggccatcgagcgtattctttagcctggttgcagcaagaaaccagggcacgcccctanagatcgtagtctatggtncatccagtattgacgaagggtcgggtacccagtccgaggttcaggtggcgtagtgctagtcgtgggacagtattacactctactactatcacgcacgctgcgtacgctagtaagttatttacgaacttaagttttacttacgtacgtaacaagttagttaacttacgtaaccgttacccgtacggttacggtacccggttaccgggaccgtaagggggaccctaaagggtacggaaacgtacccgaaaccggtacgttaggcggtctcggacc

SEQ ID NO: 214731 - DNA, 557 bp, Homo sapiens
  misc_feature: GYAE6OF01CP62H.1.34.D01.1.454.CMB.1.raw
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (550)..(550): a, c, t, g, unknown or other
  misc_feature (550)..(550): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatccacgttggccgggcgagtcacggccatcagcgtattctttagcctggttgcagcaagaaaccgngggacgacgcccctanagatcgtagtctagtggtgcatccagattgacgtaacgggtcgggtccagtccgaggttcgaaggtcggacaggtcgactagtcggtagggaactaggtaactttaccgacttcctacacttancagcncgcctgcacgcctagtatattttgacttaatttatactacgtacaagttatattactaaccgttacccgtaggtcggtacgttcggaccggtagggaaccgagggtcgaagtccgaaacgtatggcgngcgtacc

SEQ ID NO: 214732 - DNA, 593 bp, Homo sapiens
  misc_feature: GYAE6OF01DTECJ.1.34.D01.1.454.CMB.1.raw
  modified_base (102)..(102): a, c, t, g, unknown or other
  misc_feature (102)..(102): n is a, c, g, or t
  modified_base (284)..(284): a, c, t, g, unknown or other
  misc_feature (284)..(284): n is a, c, g, or t
  modified_base (437)..(437): a, c, t, g, unknown or other
  misc_feature (437)..(437): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctatggagacagatcaccatcacttgccgggcgagtcaggccatcagcgatttctttagccttggttgcagcaaggaaaccgagggcacgcccctnagatcgtagtctagtggtgcatccagtattggcgaagggtcgggtccctagtccaggttcaggtgctaggtcgctagtcgtggggaactaggtaacttaccaccttactctaacttactacgaacgcacgcctgcctacggcctagtaagttnttttagacttaaattttacttacgtcgtaacaaacgttagttaatttacgtaaccgtaaccccttagggtcggtaccggttccgggaccgtaagggggaccctaaaggggttacggaaccggtacctaaaccggaacgttggtcggcctggtaccc

SEQ ID NO: 214733 - DNA, 411 bp, Homo sapiens
  misc_feature: GYAE6OF01EJ5XG.1.34.D01.1.454.CMB.1.raw
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (405)..(411): a, c, t, g, unknown or other
  misc_feature (405)..(411): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctagaagtattttgactaatttattactgtacaactagttattatacgtacccctaggtcggacgttcggaccgaggggaccaaggtggaacgtcgaaccgacgtgaggctgacactatctgtcttcattcctcccgctntcgtacgaacgctactcgtctgcggcggtctggacaggcanatgnnnnnnn

SEQ ID NO: 214734 - DNA, 718 bp, Homo sapiens
  misc_feature: GYAE6OF01AJKYN.1.34.D01.1.454.CMB.1.raw
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacgttgccgggcgagtcaggccatcagcgtattctttacgccttggttgcagacaacgaaaccgnggggaccgacgccccctagagactcgtagtctagtggtcgctactccaggtattcggacgtaaggggtccgggtacccaacgtccgtagggttacagggttcggaccgtaggtcgacgtaacgttccggtagggtacctaagggttacttaaccgaccttccgtacctaacttagtccgaacgccgacgtcccgttagccgaacggtcccgttaagggtaaacgtttagttttacggtaacttttaaacgtttttacgttaaccgttcggtttaaacctaaaccgtttaagtttaaccgtttaaccgttaacccggtttaacccccggttaggttaccggggttaaccggtttacccgggaccccggtaaggggtaacccctaaggggtaccgttaaaccgtaccgtaaaccggtacgttacggtcggcgtacgtaacccg

SEQ ID NO: 214735 - DNA, 709 bp, Homo sapiens
  misc_feature: GYAE6OF01ALHKF.1.34.D01.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttcggccgggcgagtcaggccatcagcgtattctttagccttggttgcagacaagaaaccgagggcgacgcccctnagtatcgtagtctagtggtcgactatccagtattcggacgtaaggggtcgggtacccacgtccgtaggttcaggtcggacgtaggtcgactacgttcggagggacctaaggtactttaaccgacctttccgtaccttaaaccttacttaccgacgtacccgtaacggtccccgttaggacccgtaacggtcccgttaagggtaaaccgttttagtttttaccggaactttttaaacgtttttaattaaccgttacgttaacctaaacgttaacgttttaacgttaaacggttaacccccgttaccccgttacgggttaccggttaaccgggttcccgggaccgggtaacgggggtaacccgtaagggttaccgggaaacttacccggaaacggtacgttgggtcggtaccgtgtaacccg

SEQ ID NO: 214736 - DNA, 500 bp, Homo sapiens
  misc_feature: GYAE6OF01DWCBW.1.34.D01.1.454.CMB.1.raw
  modified_base (459)..(459): a, c, t, g, unknown or other
  misc_feature (459)..(459): n is a, c, g, or t
  modified_base (482)..(500): a, c, t, g, unknown or other
  misc_feature (482)..(500): n is a, c, g, or t
tcagacgagtgcgtcacgaccggtgctcgatttagatcgtctgtgttgggtttgggagtcaggccatcagcgatttctttagcctggttgcagcagaaaccagggcgagccccctcagatcgtagtctatggtgcatccagattgcgaaggtggggtcccatccaggttcagtggcaggtgcatcgtgggacagtattaccactctcactatcagcagcctgcacgcctagtaatttattttgactaattttacttacgtgtaccaaatagttaacttactaaccgtacccccgtagtggtaccggttcggaccggaacgggggaaccgaagggttagggaaacgtaccgaaaccggtaagtggtacggctagacccactacttcttacgttccttacgacttcccgtcccgactacgtctacgaaccgtctacgttccgtcgtaggacgccgggttcncggaacgaacgggcctagtatgnnnnnnnnnnnnnnnnnnn

SEQ ID NO: 214737 - DNA, 571 bp, Homo sapiens
  misc_feature: GYAE6OF01CKLN0.1.34.D01.1.454.CMB.1.raw
  modified_base (272)..(272): a, c, t, g, unknown or other
  misc_feature (272)..(272): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttgcagcaagaaaccgngggcgacgcccctacagtactcgtagtctagtggtgcatccagtattggacgtaaggggtcgggtcccagtccgtaggttcaggtcggacgtagtgactagtcgtagggacagtacttacactctacactatcacgcagtcctgccagccgtagaagttagtttagacttaattttacttacgtagtactaactagttaattacgtacgttaccccgttaggtcggtaccgttccgggaccgtaaggggaccgtaagggacggaacgtaccgaaacgtacgtagggtccgtcgtgaccc

SEQ ID NO: 214738 - DNA, 736 bp, Homo sapiens
  misc_feature: GYAE6OF01D6PAN.1.34.D01.1.454.CMB.1.raw
  modified_base (196)..(196): a, c, t, g, unknown or other
  misc_feature (196)..(196): n is a, c, g, or t
  modified_base (536)..(536): a, c, t, g, unknown or other
  misc_feature (536)..(536): n is a, c, g, or t
tcagacgagtgcgtcacgaccggtgctcgatttagatcgtctgtggttgggttggggagtcagaccctgtcaggacacagcatggacatgaggtccccgctcagctccgtgggcctcctgctgctctgctcccgaggtaccagctgtgacatccaattcgacccagttctccatcctcctgtctgcatctatgganactagagtccaccatcgacttcggccggtcgagtccacggccctatccgaagtccgtattttccgtttaagtcccggttggtttacgacacggacctaagggaaaacccagggggccgaccggcccccctaaggacgtaacgtttaccggtaaatttccggttaacttggggtctacgacgtacccgtaagtaacgtttgaccggtaaacggggttccgggtacccctaagtacccgtacggtttacggcgttaacgggccttaaggtcgaccgttacggtacgtacgggacgtaaagtacgttaactaaccttcgtaccctattaactacgacgtaccncgaccgttcgacgaccgtcgaacgtagttagtttacgtaacgtaaacttttctaacgtttcaagttaaacgttaatttcgttaaactaccgttaaacccgtcgggttaaccgacggtttccggaaccggtaaggggaaccgaaggggttaaccggtaataaccggtaacccgtaaaggttgtccggaagtcgtaaacccg

SEQ ID NO: 214739 - DNA, 695 bp, Homo sapiens
  misc_feature: GYAE6OF01C6H9T.1.34.D01.1.454.CMB.1.raw
  modified_base (195)..(195): a, c, t, g, unknown or other
  misc_feature (195)..(195): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctatgganacagagtcaccatcacttgccggcagtcaggccatcagcgtatttcttagcctggttgcagacagaaaccgngggccgacgcccctnagtatcgtagtctatggtgcatccaagtcgttggacgtagggtcggtaccagtcctaggtcagtggctagtcgctatcgtagggactagtattaccgtactccttacgaacttagtaccgaacggcctaaggcccctttaggacccgtaacgtacccggtttaaggtaaaacggtttctttttaacgggacttttaaaagtttttaacgttaaccgttacgggttaaaccaaacgtttaaggttaactttaacgttaaacccggttacccgtttaaacggtccgggttaaccggtttacccggggtacccggtaaaggggggtaaccccgtaaaggggtttaccggggaaaaacgttacccggtaaaacccggtaactttccggggtaacggaacccgtttcgggaaaccccc

SEQ ID NO: 214740 - DNA, 400 bp, Homo sapiens
  misc_feature: GYAE6OF01A83CM.1.34.D01.1.454.CMB.1.raw
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
  modified_base (392)..(400): a, c, t, g, unknown or other
  misc_feature (392)..(400): n is a, c, g, or t
tcagacgagtgcgtcacgaccggtgctcgatttagatcgtctgtggttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaatttattactgtacaactagtattatacgtacccctaggtggacgttcggccgaggggaccaaggtggaagtcaaccgaatgngctgcacatctgtctcatctccgcatctgaacnctactcgtctgacgcgggctacggcaaggcgacagtagnnnnnnnnn

SEQ ID NO: 214741 - DNA, 531 bp, Homo sapiens
  misc_feature: GYAE6OF01DW5MC.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcagaaaccngggcgacgcccctnagatcgtagtctatggtgcatccagattgacaagggtcgggccatccaggttcagtggcagtgnatcgngggacagtattacactctcactatcagcacgcctgcacgccttagaagttatttgacttaattttattactgtactaatagttattataacgttacccctaggtcgtaccggttcggaccgtaaggggactaaagggtacggaacgtacgaaacccgaaacttgggtagccgtcgaaccc

SEQ ID NO: 214742 - DNA, 718 bp, Homo sapiens
  misc_feature: GYAE6OF01D7OH1.1.34.D01.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtctccatcctccctgtctgcatctatgganacagctcaccatcacttggccgggngagtcaggccatcgagcgtattcttacgcctggctgcagacaagaaccgagggccgacgacccctgaacgtacgtcgtagtcgtagtggtgacactccgagtagttacgacggtacgggtcgggtcccagtaccgtaggttcagggtcggacgtaggtcgacgtacgtccggtacgggtaactaagtaacttacctactacctaccgtaactacgtacgacgaccgtaacgtcctacggccgtacgtaccgttaaggttaacgtttacgttttacggtaacttttaaactttttacttaaccggttactttaaacctaaacttaaacgggtttaactttaaaaccggttacccgtttaaacccggtaacccggttccgggttaacccgggttacccgggtacccgggtaaacgggggtaaacccggttaaaggggttaccggtaaaaccgtaccgggtaaaacccgttaggttacgggttcggaacgttaacccggg

SEQ ID NO: 214743 - DNA, 704 bp, Homo sapiens
  misc_feature: GYAE6OF01D24FF.1.34.D01.1.454.CMB.1.raw
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgctcagctcctggggcctcctgctgctctggctcccaggtaccagctgtgacatccaattgacccagtctccatcctccctgtctgcatctattgganacagagtcaccatcgacttggccggcgagtcaggccagtcagcgtattcttagcctggttgcagcacgaaaccagggcgacgcccctcaggtctcgtagtctagtggtagcactaccgagtattcgacgaacggggtcgggtcccctagtccgtaaggttcgaggtcgggacctagtccgtactagtcgtaggggaacctaggtaactttaaccgaccttcgtacctaacgttactcgaacgtcgaaccgtcctaggacctacggaccgttaggtaaagtttacgttttagaaccttttaaagttttaaacttccggtagtttaacctaagttaaacggtttaactttacgttaacccggttaacccccgtttaagggtaccgggttaccggtttacccggggaacccgtaaacggggggtaaaccccgttaaagggggtagggttaaaccggtaccccggtaaaacgggtaaccgttttagggaccgggtaccgttcggaacccc

SEQ ID NO: 214744 - DNA, 667 bp, Homo sapiens
  misc_feature: GYAE6OF01CHTLC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctccaggtaccagctgtgacatccaattcgaccagtctccatcctccctgtctgctagtcgtagttggagacgagacgtcaaccatccacgttcggccgggacgagtcgacggccagtcgacgtcgtattttccgtttagcccgttgggttcgcaggaccgaacggaaaccgcggggccgaccgtccccgtcgaagtactcggtaggtcttagtggtcgctacgtccagtacttgacgtaaggggttcggtacctagttccgaggttcgaggttcggctaggtcgctacgttcgtacgggactacgtacttaccgacttactactactaacgtcgaacgtaccgacgtcccgtggacctacgtaccgtaaggtaacgttcgttttacgaactttaagtttacgtacgttacgtaacgtaacttagtttaaccgtttacgtacccggttaaccgtagggtacggtacggttaccggacgggtacgggaacgttagggacgtaacggaccgtaaacggtacttggtcgcgttgacccg

SEQ ID NO: 214745 - DNA, 718 bp, Homo sapiens
  misc_feature: GYAE6OF01B57AX.1.34.D01.1.454.CMB.1.raw
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttcggccgggcgagtccgaggccatcagcgtatttctttagccttggttgcagcaagaaaccgagggcgacgcccctcgagactcgtagtctagtggtcncactccagtattcggacgtaacggggttcgggtaccccagttcccgtagggttcaaggtcgggacgtaggtcgacgtacgttccggtaggggaactagggttaactttaacccgaacttccttaaccctaaccgtttaacttaccgaaccggtcctaaaccgtcccgtaacggtccaacggtccccttaaagggtaaaggttttactttttacggaactttaaatttttacttacgtttacgtaactaaacgttagttaaactttacgtaaccggttaacccccgttaggttaccgggttaacccggttccggggaacccggtaacgggggtaacccgtaaaggggtacggtaaaaccggttacccgtaaaaccggtagttacgggtcggtaccgttcggaaccc

SEQ ID NO: 214746 - DNA, 591 bp, Homo sapiens
  misc_feature: GYAE6OF01AMAVW.1.34.D01.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcagaaaccagggcagcccctnagatcgtagtctatggtgcatccagtattcgacgtaaggtcgggtaccccagtcccgtaggttacaggtcgggcaggtcgactagtcgtaggggacagtacttaccacttctactacttacncagccagcctgctagtcctagtaagtnttttacgactttaaatttacttacgtacgttactaaaccgtagtttaacttacgtaaccgttaccccgttacggttacggtaaccgttccgggacccggtaacggggtaaccaagggtacggaaacgtaccgaaaccggtactagggtacgccgtggtaccc

SEQ ID NO: 214747 - DNA, 671 bp, Homo sapiens
  misc_feature: GYAE6OF01CJ3C7.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccggngagtcaggccatcagcgattcttagcctggttncagcagaaccngggcgacgcccctnagatcgtagtctatggtgcatccagattgactaagggtcgggtcccaagtccgaggttcaggtcggcagtcgacagttcgtggggactagtaattaccgacttcctacgtacttactaccagaccacggccctgaccacggtacccttaggtaaacgtttacttttacggaactttaaattttactttaaccgttacgttaactaaaccgttaagtttaaacttttacgtaaaccggtttaacccccgttagggttaaccgggttaaccggttttacccggggacccgggtaaaggggggtaaaccccgtaaagggggttaccgggtaaaacgggttaccccgtaaaacccgggtaaacgttcggggtaaccggtcgttaccggtaaccccg

SEQ ID NO: 214748 - DNA, 535 bp, Homo sapiens
  misc_feature: GYAE6OF01BS72B.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagcctggttgcagcagaaaccagggcagcccctnagatcgtagtctagtggtgcatccagtattgacgaaggtcgggtcccagtccgaaggttcaggtggcagtgcatcgtagggacagtattacactcgtacactatcagtcagcctgcagtcctaggattattttgacttaatttattactgtacaactagttattacgtacgtaccccgtagtcggtaaccgttcgggaccgtaggggacctaagggtcgtaaagtccgaaaccgtacgtaggtcggcgtgtacccg

SEQ ID NO: 214749 - DNA, 674 bp, Homo sapiens
  misc_feature: GYAE6OF01EDT63.1.34.D01.1.454.CMB.1.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattcgacccagtctccatcctccctgtctgcatctattgganacagagtcaccatcacgttcggccgggcgagtcgacggccatcagtcgtatttcgttagtccgtggttgcagacgaacgaaaccgngggacgacgcccctgagtagtcgtagtctagtggtcactactcgagtagttggacgtacgggtcgggtacccagtccgtaggttcgaggtcggcgtaggtcgacgtagtcggtagggaactaagtacttaaccgaccgttactacgtaacttataccgacgtacgacgtccgtacgaccgacgtaccgtaaggtaacgtttagttttacggaactttaacgtttttaagtaccgtacgttaacctaacgttagtttaacttaacgttaacccgttaaccccggttagggttaccggtacccggttacgggaccggtaacggggtaacctaagggttaccgggtaaggtaaaccgttaccgaaacccggtagttcgggtcgtcgtaccg

SEQ ID NO: 214750 - DNA, 602 bp, Homo sapiens
  misc_feature: GYAE6OF01D21J8.1.34.D01.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcagcgattcttagcctggttgcagcagaaaccngggcgagcccctnagatcgtagtctatggtgcatccagtattgacgaagggtcgggtcccagtcccgaggttcaggtcggcagtgctatcgtagggacagtacttacacttctcactatcagcacgtcctgcctagtcctaggtaacgttattttcgactttaaattttacttaaccgttgtaacctaaacgttagttaactttaacgttaccgttaacccccgttaagggttccgggtaccggtttccgggaccggtaacgggggtaaccctaaaggggtacgggtaaacgtacccgtaaacccgggtaacgttggtcgggtctcggtaaccccg

SEQ ID NO: 214751 - DNA, 824 bp, Homo sapiens
  misc_feature: GYAE6OF01AWV43.1.34.D01.1.454.CMB.1.raw
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaacctatcacttcggccgggcgacgtcaggccatcagcgtattctttagcctggttgcagacaagaaaccgaggggccgacgcccctanagtactcggtagtctagttggtcgctactccgaagtatttcggacgtaagggggtccgggtccccaagttcccgtaaggttcgaggtcggacgaggttcgactagtcgtaggggtacctaaggtaacttttaaccgacccttactacctacgttaacttaccgaacggtacccaacggtccccgtaggtacccgtaacggtacccgtaaggggttaaacgtttacgttttttaaccgggaactttttaaaacgtttttaaccgtttaaccggttaacggttaaaaccctttaaacggtttaaacgttttaaacgttttaaaaccccgtttaaccccgggtttaaacccccccgtttaaacgggggtcccggggtttaaacccgggtttaccccggggaaccccggggtaaaccgggggggttaaaaccccggttaaacgggggtaaaccggggttaacccggttaaaccccggtaaaaccccgggttaacgggttaccggttaccgggtacccgttacgggtaaaccccc

SEQ ID NO: 214752 - DNA, 615 bp, Homo sapiens
  misc_feature: GYAE6OF01AMYW5.1.34.D01.1.454.CMB.1.raw
  modified_base (288)..(288): a, c, t, g, unknown or other
  misc_feature (288)..(288): n is a, c, g, or t
  modified_base (443)..(443): a, c, t, g, unknown or other
  misc_feature (443)..(443): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcgagtcaggccatcagcgtattcttagccttggttgcagcaagaaaccgagggccgacgcccctanagatcgtagtctagtggtgcatccgagtattgacgaagggtcgggtcccagtccgaggttcaggtcgcgagtgctagtcgtacgggacagtacttaccacgttcctactaactataccgagccacgcccgttagccgacgtcctaggtaacgttnttttacgactttaatttaacttacgtacgttaccaaacgttagttaactacgttaacccgttacccgtacggttacgggtaccggttaccgggaccggtaacggggaacccgttaaggggtacggtaaacggtaccgtaaaccggtaacgttaggcggtcctcggtaacccg

SEQ ID NO: 214753 - DNA, 641 bp, Homo sapiens
  misc_feature: GYAE6OF01CJZ76.1.34.D01.1.454.CMB.1.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (464)..(464): a, c, t, g, unknown or other
  misc_feature (464)..(464): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctatggagacagagtcaccatcacgttgccgggcgagtcaggccatcagcgtatttcttagcctggttncagcaagaaaccgngggcgacgcccctanagatcgtagtctagtggtcncactccgaagtagttggacgtaacggggtcggtaccctagtccgtaagggttcaagggtcggctaaggtgacagtccgttagggaactagtaacgttaccacttaccactactaagtacaacgtacgacgtccagccgtaagccgtaagtaacgttntttagactttaaatttattacgtacgtaactaactacgttaatttactaccggttaacccccttagggtaccgggtaccgttaccggggaccccggtaaagggggtaaaccctaaggggtacggtaaaacggtacccgtaaaaccggtacgttagggtaccggccttacggtaaccc

SEQ ID NO: 214754 - DNA, 765 bp, Homo sapiens
  misc_feature: GYAE6OF01CYA4L.1.34.D01.1.454.CMB.1.raw
  modified_base (197)..(197): a, c, t, g, unknown or other
  misc_feature (197)..(197): n is a, c, g, or t
  modified_base (262)..(262): a, c, t, g, unknown or other
  misc_feature (262)..(262): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatcctcctgtctgcatctatgganacagagtcaccatcacttcggccggcgagtcaggccatcagcgtattctttacgccgttggttcncagacgaacgaaaaccgngggaccgacgtcccctagagtacgtcgtagtctagtggtgactataccagtagttcgacgtaaggtcggtacccagtccgtaggttcgaggttcggactaggtcgacgtaacgttcgtacgggaactaggtaactttaccaccttcgtacctaactacgtacgaacgactacggtaccgtgaaccgtacgtacccgttaaggttaaacgtttacgtttttacggtaacttttaaactttttaacgtttacccgttaacggttaacctaaaacgtttaacgtttaaacgttttacccgttaaacccggtttaaaccccccggttaagggtttacccggggttaacccgggtttaccccggggtaaacccggggttaaacgggggtaaaccccgggttaaaaggggttaaccggggttaaaaccgttaaccccggtaaaacccggtaacggtttacggggtaccggtaaccgttccggtaaaccccg

SEQ ID NO: 214755 - DNA, 642 bp, Homo sapiens
  misc_feature: GYAE6OF01D5HQL.1.34.D01.1.454.CMB.1.raw
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcctcctgctgctctggctcccaggtaccagctgtgacatccaattgacccagtctccatccctccctgtctgcatctagttggagacagagtccaccatcacgttcggccgggcgagtcaggccatcagcgtattctttacgcctggttgccagacaacggaaaccgacggggccgacgccccctanagtactcggtagttctagtggngcatccagtactggacgtaacggggtcgggtacccagtccgtaggttcgaggtcggcgtagtcgactagttcgagggactagtacttaccacttcctactacctancgagacacgtcctagcacgtcttagtaagttctttacgacttaatttatactagtactaagttattacttacgttaccgtaccccgtttaggtaccgggttaccggttacccgggtaccggtaagggggaacccgttaaaggggttaccgggtaaaccgaacccggttaaaacccggtacggtttgggacccggtacgtccggtaaccccg

SEQ ID NO: 214756 - DNA, 814 bp, Homo sapiens
  misc_feature: GYAE6OF01D1MGM.1.34.D01.1.454.CMB.1.raw
tcagacgagtgcgtcacgaccggtgctcgatttagatcgtctgtgttgggtttgggcatggacatggagggtccccgctcagcttcctgggggcttcctgtctgctctggctcccaggtaccagctgtcgacatccaattggacccagtctccatcccttcctgtctgtactaatcttaatggagacagtacgtcaccattcacgttcggccgggacgagggtcgaacggtccaagtcgacggtcgtactttcgtttacgccgttgggttcgacaaggacaaacgtaaaccgaggggccgaaccgtccccctagtacgtacttacggttacgttcttaagtcggtgaccgtacgtccgaagtcgttaggcggtaacgggtcggggtaaccctgtacccgtaggttccgtagggtcgtacgtagtcgtacgtagttcggtaagggaactaagttaaacttaccgacttacgtactaacgtacgtacgaaccgggtcctaacgtcccgtacgaccgtaacgtacccggttaaagtaggtttaacttactaaacgttttaaacgttttaaccttaccggtaatttaacctaaaccgttaaattttaacgtttaaacccgtacggttttaaacccccgtaggggttaccggttaacccggtcgggaaccgggtaacggggaaaccgttacgggtaaacggaaccttaaccggtaaacccgtaacggtttggtaaacccggtgaacccgaccttaaccttagttacccgttagtttacccgtaacccttacccgtccccctaaaccccggttaaccccc

SEQ ID NO: 214757 - DNA, 753 bp, Homo sapiens
  misc_feature: GYAE6OF01BBCFV.1.34.D01.1.454.CMB.1.raw
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatcctccctgtcctgcatctattggagacagagtcacctatcacgttggccgggngagtcaggccatcagcgtatttcttagccttggttcgcagcaagaaaccgaggggccgacgcccctanaggtactcgtaagtctagtgggtctacactccgaagtacgtttagacgtaacggggttcggggtaccccctaagttcccggtaagggtttccgaagggttcgggaccgtacggttcggacgtaaggttcccggtaggggaactaacggttaactttaaccgtaccgttaccttaccaaactttacgtaccgaaccgacgttacgcccgtaggaccgtacgtaccgtaggtaaagtttacttttacggaactttaaagttttacgttaacgttacggttaacctaaacgttaacgtttaattaacccgtaacccggttaaccccttaaagggtccgggtaaacccgggttttcccgggaaccgggtaacgggggaacccggttaaacggggtacgggtaaaacccgtttacggaaaacccgggttaacggttacggtacgggtcctacgggtaacccg

SEQ ID NO: 214758 - DNA, 589 bp, Homo sapiens
  misc_feature: GYAE6OF01DRCB1.1.34.D01.1.454.CMB.1.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (455)..(455): a, c, t, g, unknown or other
  misc_feature (455)..(455): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtatttctttagccttggttgcagcaagaaaccgnggggccgacgcccctnagatcgtagtctagtggtcgctactccgaagtattcggacgtaaacggggttcggggtaccccaagttcccgagggtttccaagggttcggactaggtcgactagtcgtagggaacaggtacttacgactctcactatcagcagtccctgcacgacttagaacgttnttttagacttaaattttactacttgtaccaaacttagttaacttacgaccgttaaccctaggtcggtaccggttcggaccggtaggggaaccaagggtacggaaatccgaaaccggtagtggtcgcgtacgccc

SEQ ID NO: 214759 - DNA, 583 bp, Homo sapiens
  misc_feature: GYAE6OF01AV36C.1.34.D01.1.454.CMB.1.raw
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggcgagtcaggccatcagcgattctttagcctggttgcagcaagaaaccagggcgacgcccctcgagatcgtagtctagtggtncatccagattgcgtaagggtcgggtacccagtccgaggttcaggtcggcagtgctatcgtagggacagtacttacactctcactatacagcacgcctgccgacgtcctaggtaagttattttacgactttaaatttacttacgtagtactaaacgttagttaactttaactaccggttaacccgttacgggtacggtaccgttcgggacccgtaagggggaacctaggggtacggaacgttaaccgaaaccggttaacggtggtcggtcgtcgtaacccg

SEQ ID NO: 214760 - DNA, 752 bp, Homo sapiens
  misc_feature: GYAE6OF01EQDWB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccggcgagtcaggccatcagcgtattcttagcctggttgcagacaagaaaccgagggccgacgcccctacgagatcgtagtctagtggtcgctacgtaccgagtagttcggacgtaacggggttcggggtaccctacgtacccgtacgggttacgaggttcgggacgtagtcgacgtaacgttcgtacggggtaactaacgttaactttacccgtaaccgttacctacctaacgttaaccgtacgtacgccgaacggtccctcgtaccgacgtacccgttaaggtaaagttttacttttacggtaactttaaacgttttttactttaacccgttacgttaaaccgttaacgttaacgtttaactttaacgttaaacccgtttacccccggtaaccgggtttaccggggttaacccggttaacccgggtacccgggtaaacggggtaaacccggtaaaggggttaaccgggtaaaaccggtaacccggtaaaacccggtacggttaagggttaccggtaccgttccggtaacccg

SEQ ID NO: 214761 - DNA, 944 bp, Homo sapiens
  misc_feature: GYAE6OF01CPP22.1.34.D01.1.454.CMB.1.raw
  modified_base (106)..(106): a, c, t, g, unknown or other
  misc_feature (106)..(106): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttagggtttggggagtacgagaccctggtcaggacactagcatggacatgacggtccccgngtcagctcctgggcttccgtgctgcctctggcctccccaggtacccagctgttcgacctacttcccaattcgacccctagtcctccactcctccctgtcctgcatctagttgganacagactcaccatccacttcgccggnagtcacggccagtcgagccgtacttcttacgccttggttcgcagcaaggaaaccgngggaccacgcccctgaacgtctccggtagtcctagtacggtacgcgtacgtaccgagtacgttacggaccgtaaccggggttcggtaccccctagttacccggtacgggtttaccaacgggttcggaccgtaagggtccggtacctaacggtttccggtacggggaacccttaacgggtaacctttaaccccgaccgtttacccgtacgtaaccgttaacgttcggaacggtacctaccggtcccgttacggacccttaaccggtacccgtttaggtaaaaccgtttacgtttttacgaaccgtttttaaacgtttttaaccgttaaccgtttacggttaacccgtaaaccgtttaaacggttttaaacgttttaacccggtttaaaccccgggttttaaccccccggtttaaacggggtttaaacccgggggttttaaccccgggttttaacccgggggaaacccccgggggtttaaaacccggggggggtaaacccccgtttaaaagggggggtttaaaccccggggttaaaaaacccgggtttttaaacccccggtaaaaaccccggggtttaaacccggtttcccgggggtttaaaccccggggttaccccgttttaacccgggggttaaacccccg

SEQ ID NO: 214762 - DNA, 691 bp, Homo sapiens
  misc_feature: GYAE6OF01BZ00I.1.34.D01.1.454.CMB.1.raw
  modified_base (103)..(103): a, c, t, g, unknown or other
  misc_feature (103)..(103): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatggagggtccccgntcagctcctggggctcctgctgctctggctcccaggtaccagctgtgacatccaattcgacccagtctccatcctcctgtctgcatctatggagacagacgtcacctatcacgttcggccgggcgagtcaggccatcgagcgtatttcttagccttggtgcagacaagaaaccgngggccgacgcccctagacgtagtacgtagtctagtggtacgctagtccgtagtacgttcggacgtaaggggtccggtacctagtacccggtaggtttcgaagggttcggacgtacggtcgtacgtagttacggtacgggaactaaggttaacgttacctaccgttcgttacctaacgttacgtacgaacgtccgtaacggtcccgttaggaccgtaacgtccgtaagttaacgtttattttacgaactttaaattttacgtaacgttctaaactaacgttacgtttaacttaccgttaacccgtacccgttacggtacgggttaacccgttaccgggaccggtaacggggaaccgtaagggtacggtaaaccgtaaccggtaaccgtacggttggtaccgtgtcccgtaaccg

SEQ ID NO: 214763 - DNA, 563 bp, Homo sapiens
  misc_feature: GYAE6OF01D6JQ9.1.34.D01.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (388)..(388): a, c, t, g, unknown or other
  misc_feature (388)..(388): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatccctccctgtctgcatctattgganacagagtcaccatcacttgccgggcgagtcaggccatcagcgattcttagcctggttgcagcagaaaccngggcgagcccctnagatcgtagtctagtggtncatccagtattgcaaggtcggtccatccgaggttcaggtgctagtgcatcgtggacagtattacgctctcactatcagcagcctagcanccgtagtaagtacttttcgacttaaattttactacgtacgttactaaactagttaactttacgtaaccgttaaccccgtaggttaccgggtacgtttaccgggaccggtaaggggaacctaagggttaccggaacgttaacccgaaaccggtaactgggtacgtcgtcgtacccg

SEQ ID NO: 214764 - DNA, 799 bp, Homo sapiens
  misc_feature: GYAE6OF01DCOR2.1.34.D01.1.454.CMB.1.raw
  modified_base (101)..(101): a, c, t, g, unknown or other
  misc_feature (101)..(101): n is a, c, g, or t
  modified_base (219)..(219): a, c, t, g, unknown or other
  misc_feature (219)..(219): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccntcagctcctgggctcctgctgctctggctcccaggtaccagctgtgacatccaattgacccagtctccatcctccctgtctgcatctattggagcagagtcaccatcacttgccgggngagtcaggccatcagcgtattcttagcctggttcgctagcaagaaaccagggccgacgcccctnagattacgtagtctatggtcgacactcagtattcgacgaagggtcgggtacccagttaccgagggttacaggttggctaaggtcgctagtcgttacgggactaaggtaacgtttaaccacgttacctactaaacgttacttaccgaacgtacgtaccggtacccttacggacccgtaacggtcccgttaagggttaaacgttttcgtttttaacgaaccgttttaaacgtttttacgtttaaccgttacgggtttaaccgtaaaccggttaacggtttttaaacgttttaaccgggtaaacccccggtttttaaacccccgtttaaccggggttaaccggggttaacccccgggttttacccggggtaaacccggggttaaacccggggggaaaacccgtttaaaaccgggggttaacccggggttaaaaaccgttaacccccgggtaaaacccgggtttaaaacgggtttccggggttaaacccgggtcccggtttaacccggttaaacccccgg

SEQ ID NO: 214765 - DNA, 688 bp, Homo sapiens
  misc_feature: GYAE6OF01DLO0R.1.34.D01.1.454.CMB.1.raw
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttggccgggcgagtcaggccatcagcgtattcttagccttggttgcagacagaaccgngggcgacgcccctanagtatcgtagtctagtggtgctatccgagagttcgacgtaacggggtcgggtaccccagttcccgtaggttcgaggtcggacgtagtcgacgtagtcggtaggggaacaaggttacttaacccgacctttaccgtaacctaacgttactaccgacggtacccgtaacgtcccgttagacctaacggtcccgttaaggtaaacgtttcttttacggaacttttaaacgtttttaactaccgttcgtaaacctaaacgttagttttaaacttacggttaacccgttaccccgttagggtaaccgggttaccgttaccggggaaccgtaacgggggtaacctaaggggttaacggtaaaccgtaccggaaacccgttaggtcggtacggtacctggtaaccccg

SEQ ID NO: 214766 - DNA, 553 bp, Homo sapiens
  misc_feature: GYAE6OF01A6KA6.1.34.D01.1.454.CMB.1.raw
  modified_base (198)..(198): a, c, t, g, unknown or other
  misc_feature (198)..(198): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattgganacagagtcaccatcacttgccgggcgagtcaggccatcagcgtattctttagcctggttgcagcagaaaccgngggcgacgcccctnagatcgtagtctatggtncatccagtattgacgtaaggggtcgggtacccagtccgaggttcaggtggcagtgctatcgtgggaacagtacttacactctacactatcagcacgcctgcacgtctagtaagtnttttagactttaattttactactgtactaactagttaacttactaccgttacccgtaggtcggtaccggttcggacccggtagggggaaccaaggggtacgaagtacccgaaacgtacgtgtcggtcgtgtaccc

SEQ ID NO: 214767 - DNA, 735 bp, Homo sapiens
  misc_feature: GYAE6OF01ETK62.1.34.D01.1.454.CMB.1.raw
  modified_base (292)..(292): a, c, t, g, unknown or other
  misc_feature (292)..(292): n is a, c, g, or t
  modified_base (537)..(537): a, c, t, g, unknown or other
  misc_feature (537)..(537): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatccctccctgtctgcatctattggagacagagtcaccatccacgttcggcccgggcgtagtccgaggccatcgagtcgtatttccgtttagccgttggttgcagacaaggaaaccgngggaccgaccgcccctagagtacgtacggtacgttcgtagtgggtcactactaccgtaagtacgttcggaacggtacggggtccgggtacccaacgttccggtagggtttacgaacggtcgggtacagggtacgacgtacgtcggtagggtaactacggtaactttaccgtaccttacgtacctaactacgtaccgagtccgtaaccgtccgtacgacctacggtaacccgtaggtaaacgtttntttacgaactttaaagttttaccgttaacgtacgttaacctaaacgttaagttttaacttaaccggttaccgttaaccccgtagggtttaccggaaacccgggtttccgggaaacccggtaacgggggtaaccctaaaggggtaccggtaaacgtacccggtaaaccggtacggttacggtcgtaccgtcgtaacccg

SEQ ID NO: 214768 - DNA, 792 bp, Homo sapiens
  misc_feature: GYAE6OF01C8L4O.1.34.D01.1.454.CMB.1.raw
  modified_base (105)..(105): a, c, t, g, unknown or other
  misc_feature (105)..(105): n is a, c, g, or t
  modified_base (373)..(373): a, c, t, g, unknown or other
  misc_feature (373)..(373): n is a, c, g, or t
tcagacgagtgcgtcacgaccggtgctcgatttagatcgtctgtggttggggtttgggggagtcagaccctgtcaggacacagcatggacatgacgggtccccgntcagctccgtggggctcctgctgctctggcctcccaggtaccagctgtgacatccaattcgacccagtcctccatccctcctgtctagcattctagttggagacagacgtcaaccgtatccacgttcgggccgggtcgacgtcgacggccatacgagtacgttaactttcgtttaacggtccgttggttcgaccgaagaccgaaacggaaaaccggcggggtaccgtacccgccccgtagacgtacgtccggtaagtcgtagttcggntaccagtaccgagtagttcggaacggtaacggggttccgggtacccaaggtttacccgtagggttacccgtagggtccggtacgtacgggtacgtaccgttaaggttccgggtaacgggtaacgtaacggtttaaccttaaacccgtaccttaacccgttaacctaaaccgtttaacgaaccgtaacggtaccctaacggtcccgttacggaacgtacgtaccggtttaaagtaacgtttactttacggtaaacttttaacgtttaacgttacgtaccgtaaacgtactttaagttaacttaacgtaacccggtttaaccgtgggtaaaccggttcggttaaccggacgggtaacggtaacggtacggggtacgaaccggttacgtaacccggtagttacggcggtcctacggtacccg

SEQ ID NO: 214769 - DNA, 658 bp, Homo sapiens
  misc_feature: GYAE6OF01D4P7C.1.34.D01.1.454.CMB.1.raw
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
  modified_base (439)..(439): a, c, t, g, unknown or other
  misc_feature (439)..(439): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctagttggagacagagtcacatctacgtggccgggcgagtcaggccatcgagcgtatttcttagcctggttgacagacaagaaaccgaggccgacgcccctacgagtagtcgtagttctagtggtacncgactcgagtacgtagcggaacggtccggtaccagtcctaggttcgngtaggcagtcgcgtacgtacgacggtactaagtactactactactacgtactacgtacgacgacgtcgtaccgtcgacgtcgtaaacgttgttaaacgttnttaagttacttaaactttcgttaaccacgttaccgtaacttaaagttttacgtaacccgtttaaccggttcccgaacgggtttccggtaacccgggttaggggaaccccgtaagggggtaacctaaacgggtgaaccgtaaacccgtggtaaaccggtgtcgtcgtaccgctaccttagtcctttacgaccttaccttcccgtcccttccccgtacccg

SEQ ID NO: 214770 - DNA, 782 bp, Homo sapiens
  misc_feature: GYAE6OF01BUXJ3.1.34.D01.1.454.CMB.1.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (325)..(325): a, c, t, g, unknown or other
  misc_feature (325)..(325): n is a, c, g, or t
tcagacgagtgcgtcacgaccggtgctcgatttagatcgtctgtgttgggtttgggggagtcagaccctgtcaggacacagcatggacatgagggtccccgctcagctccgtgggcctcctgctgctctggctcccaggtaccagctgtgacatccaattcgacccagtctccatcctcctgtctgcatctagttggagacaggatcacatctacgttcggccgggcgagtcgaggccatcagcgtatttcttagccgttggttcncagcaacgaaaccgnggggaccgacgtcccctgaagtacgtcgtagttctagtgggtcncgtataccgagtacgttacggacgtaacggggttccgggtacccctaagttaccccgtaggttaccgaacgggttacgggaccgaagggttcgacctacggtacggtacggggaaacctaggttaacttaacccgtacttccgtaacctaactaacgtccgacggtacctacggccttggacctacgggtaccttaagtaacgtttatttacgtaacttaacgtttttacttaaccgttacgttaacgtaaaaccttttaggttaaacctttacccggttaaacccggttaaccccctttaaacgggggttacccgggttaaccgggtttcccgggtaaaacccgggtaaccggggggttaaacggtaaacggggtttaccggggaaaaacctttacccgggtaaaaccccgggttaaagttaccggggtttacggaacccggtccggtaaccccgg

SEQ ID NO: 214771 - DNA, 654 bp, Homo sapiens
  misc_feature: GYAE6OF01BV0FD.1.34.D01.1.454.CMB.1.raw
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (471)..(471): a, c, t, g, unknown or other
  misc_feature (471)..(471): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccgngggcgacgccccctnagactcgtagtctagtggtncatccagtnttggacgtaaggggtcgggtaccccagtcccgaggtttcaggttcggactaggtcgactagtcggtacgggactaggtacttacctaccttctaccaacgttataccgaacgtccaacgtccctaggtaccacggtcccgttaaggtaaacgtttntttttacgaactttaagtttttaacttacgtacgttaacctaaacgttaagtttaagtttaaccgttaccggttaacccccggttagggtaccgggtaaccggtttccgggaccgtaagggggtaacctaaggggtaacggaacgttaccgaaaccggtacgttaggtcggccgtggtaaccc

SEQ ID NO: 214772 - DNA, 810 bp, Homo sapiens
  misc_feature: GYAE6OF01CEA30.1.34.D01.1.454.CMB.1.raw
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctagttggatacagacgtcaaccagtccgacttcggccggganaaggttcacggtcccagtccaggccgttagttctttacgcccttgggttcgctacggaccaacggaaaccgngggccgacgtcccctagagacttcgtaacgttctaagtcgggtcncctactccgaagtcgttacgacggtaacggggttcgggtaccccagttaccgtaggtttccgaacgggttcggaccgtaacggttcggtacctaaaggttccgggttaacggggacttaagggtaacctttaccgtacccgttcgtaaccgtaacgttactaccggaacgccgtaacgtcccgttagaccgtagtaccgttaggtaaaccgtttgttttaacgaacgtttaaacttttacgttaccgtacgttaaccgaaactttaggttaaactttaaccgttaccccggttaaacccggttacggggttaccgggttaaaccccgggtttcccgggtaaacccggggtaaccgggggttaaaccccgtaaagggggtttaaccggaaacccggttttaacccggaaaaccccgggtttaacgttaccggggttacccggtaccgttaacggggtaaccccc

SEQ ID NO: 214773 - DNA, 741 bp, Homo sapiens
  misc_feature: GYAE6OF01C5Z69.1.34.D01.1.454.CMB.1.raw
  modified_base (327)..(327): a, c, t, g, unknown or other
  misc_feature (327)..(327): n is a, c, g, or t
tcagacgagtgcgtcacgaccggtgctcgatttagatcgtctgtgttggggtttgggggagtcagaccctgtcaggacacagcatggacatgagggtccccgctcagctccgtggggctcctgctgctctggctcccaggtaccagctgtgacatccaattcgacccagtcctccactcctccctgtctgcatctattggagacagacgtccaccatcacgttggaccgggcgagtcacggccatcgagcgtatttacctttagccgtggttgcgagcgaacgaaaccgaggggaccgacgcccctcagactcgtagtctagtggtncgatccagtatcggcgtaaggggttccggtaccacgttaccgacggttacgtacggtgggactaggtcgtactaacgtcggtagggaactaacgtacttaccacttacctacaacttagtaccacgcgtaaccgcccgttacgccgtacgtcccgtaaggtttaaaccgttaaggtttttataacctttaaactttttaacgtttacccttaacgggtttaaacctaaacgtttaagtttaaaccggtttacttaaaccccggtttaaccccgttaaaccgggttacgggttaccccgggttaacccggggacccggtaaacggggggtaaaccccgggtaaaggggtaacccgggtaaagttacccgaaaacccgggtttacggttaggggtaccggttacgtcgtaaacccg

SEQ ID NO: 214774 - DNA, 609 bp, Homo sapiens
  misc_feature: GYAE6OF01ACUOX.1.34.D01.1.454.CMB.1.raw
  modified_base (222)..(222): a, c, t, g, unknown or other
  misc_feature (222)..(222): n is a, c, g, or t
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgtattcttagcctggttgcagcagaaaccgngggcgacgcccctacagtactcgtagtctatggtgcatccagtattggacgtaagggtcgggtaccccagtccgtaggttcgaggtcggactaggtgctagttcgtacggggtacaagtaccgttacaccttacgtaccactagtacgaacgccaacgtcccgtagaccgtacgtacccgtaggtaacgttatttacggtaacttaattttacgtactacgttacaacttaagttagtttactaaccgttacccgtacgtaggtaccggttacggaccggtaaggacggtaagggtacgaaacgtacgtaaccggtaacgttcggacgtcgtacgtacccg

SEQ ID NO: 214775 - DNA, 827 bp, Homo sapiens
  misc_feature: GYAE6OF01BXKFG.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtgggctcctgctgctcgtggctcccgaggtaccagctgtgacactccaattcgacccagtcctccatccctcctgtctgctatcgtagtggacgactagacgtacacctatcgtacgttcggccggacgacgtcgacggccacgtcgagtcgttacttttcgtttacggtccgttggtcgacgacggaacgaaacggaaaccggacggggacccgaccggtacccccgtagtaacggtacgttaccggttacgttacgttagtcgggtacaccgtacgtaccgtaaggtacgttacgggaaccggtaacgggggttccggtaccccgtacgttaccgggtaacggttcgtacgggtacggtacgaggtcgtacgttacggttacggaggtactaacgttacttaaccgtcttactaccgtactacgtacgagaccacggtacctcgacgtacgtaccgttaagtaacgtttactttaacgtaacttttaaagtttacctttaacgtaacgttaaccttaacggtttacttaaccgttttaaccggtaaacccgtttacccccgggttaggttaccccgggttaccggggttaaccgggtaacccggggtaaaaccggggttacgggaaacggggttaccggttaaaaacccgggttaacccggtaaaaccgggtttccggttacgggtaccggttacccgaaccggttaacccg

SEQ ID NO: 214776 - DNA, 661 bp, Homo sapiens
  misc_feature: GYAE6OF01ANCM5.1.34.D01.1.454.CMB.1.raw
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaaattgacccagtctccatcctccctgtctgcatctattggagacagagtcaccatcacttgccgggcgagtcaggccatcagcgtattctttagccttggttgctagcaacgaaaccgaggggcacggcccctnacgtataccgtagtcttaagtgggttcgcactccgagtacgttggacggaaggggtccgggtacccacgttacccgagggttaccaggttcgggcgtaaggtcgacgtaacggttacggtacggggaactaaggtaccttaaccgtacctccttaccaaacttacgacgtacgccgaacgcccgttacgaccgtaaccgtcgtacggtaaagttcttttacgaactttaatttaccttaaccgtgtaactaaacgttagttaacttacgtaccttacccgtcggtacggtaccggttccggaccggtaaggggtaaccgtaacgggtacggaaaccgtacgtaaacccgtaggtgtacggtcgtcgacccg

SEQ ID NO: 214777 - DNA, 708 bp, Homo sapiens
  misc_feature: GYAE6OF01AR0H2.1.34.D01.1.454.CMB.1.raw
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatctacttgccgggnagtcaggccatcagcgtattcttagctggtcgcagcaagaaccgagggcgacgcccctnagatcgtagtctagtggtncactcagtattggacgtaaggggtcggtacccagtccgtaggttacgaggtcgggactaggtcgactacgttcggtacggggaactaagggttaccttaaccaccgtttcctacctaacttaacgtaccgacggtccaacggtccctacggccaacggtccctaaggttaacggttactttttacggaactttaaacttttttaacgttaccttacggttaaactaaacttaggtttaaactttaacgttaaccccggttaaccccggtttaacgggttacggggttaacccgggtttacccggggtaacccgggtaaacggggggtaaacccttaaaggggggttaccggtaaaacgtaaccgtaaaacccgggtagttcgggtacgggtaccgtcgtaaaccccg

SEQ ID NO: 214778 - DNA, 700 bp, Homo sapiens
  misc_feature: GYAE6OF01AGEBV.1.34.D01.1.454.CMB.1.raw
  modified_base (102)..(102): a, c, t, g, unknown or other
  misc_feature (102)..(102): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgctagcagaaaccgngggcacgcccctnacgtatcgtagtctagtggtgactatccgaagtagttcgacgaaggggttcgggtacccattccgaggtttcaaggttcggacaggttcgcgtaagttccggtaggggaactaaggtactttaaccgccttacgtaccaaaccgttataccgaacggacccgtaacgtccccgttaacggaccgtaacggtacccgttaagggttaaacgtttactttttacgggaaccttttaaagtttttaaacgtttaccggttaacgttaaccctaaaggttacgttttaacgttaacccgttaaccggttaaccccgtagggttaccgggtacgtttacccgggaccggtaacggggtaacctaggggtacggtaaacgtaccggtaaaaccgtacggttacggtcggtaccgttggaaccc

SEQ ID NO: 214779 - DNA, 678 bp, Homo sapiens
  misc_feature: GYAE6OF01AWA7R.1.34.D01.1.454.CMB.1.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (396)..(396): a, c, t, g, unknown or other
  misc_feature (396)..(396): n is a, c, g, or t
  modified_base (654)..(654): a, c, t, g, unknown or other
  misc_feature (654)..(654): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgtattctttagcctggttgcagcaagaaccgngggcgacgcccctnagatcgtagtctagtggtgcacgtccagtatttcggacgtaaacgggggttccggggtcccctaagttcccgtagggtttccgaggttcgggcgtaggtgacctagttccggnggggtaacaggtacttaaccaccttcctacgtaaccttacgtaccgacggaccgtaacgcccttagacccgtacggtacccgtagtaaacgtttcgtttttacggaacttttaaagttttaactttacgttagttaacctaaacgttagttaactttacgtaaccgttaccccgttacgggtacgggtacccggttaccgggaccgtaacgggggtaaccaaggggttacgggtaaaccgtacgtaaacccggttaancgggttcggaccgtcggtaacccg

SEQ ID NO: 214780 - DNA, 630 bp, Homo sapiens
  misc_feature: GYAE6OF01AQ37A.1.34.D01.1.454.CMB.1.raw
  modified_base (257)..(257): a, c, t, g, unknown or other
  misc_feature (257)..(257): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgacgaagggtcgggtcccatccgaggttcaggtggacaggtcgactagtcgtggggaacaaggtaacttaaccacttctactaacttaatcgaagtccaagccctgccaacgtcctagtaaagtattttgaacttaattttaacttactgtacaaactaagttaatttaacgtaacgttaaccccgttacggtcggtaccgtttccgggaccgtaacgggggaaccgtaagggtaaggtaaaccgtacgaaaacccggtaacgttaggtaccggtccgtacggacccaaccgtaacgtttccgttacggtttacctttacctaccttcccgttaccccgaacccg

SEQ ID NO: 214781 - DNA, 608 bp, Homo sapiens
  misc_feature: GYAE6OF01E2NTU.1.34.D01.1.454.CMB.1.raw
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctgagatcgtagtctagtggtcncatccagtattgacgtaaggtcgggtcccagtccgaggttcacggttcggactaggtgacctagtcgtagggactagtacttacctactccgtacaacttacgtacagctacgcctacgctacgccttaaggtaacgtttatttacgactttaagttttaactacgtagttaacctaaacgtagttacttaacgttaccgtaacccttagggtacggtaccgttacccggggcgtaaccgggggaactaacggggtaggaacgttaccgaaacccggttacgttaggtccggtcgtacgtacccg

SEQ ID NO: 214782 - DNA, 490 bp, Homo sapiens
  misc_feature: GYAE6OF01A0CQW.1.34.D01.1.454.CMB.1.raw
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgctaatttatactgtacaacagtattatacgtacccctagtggaccgttcggccaggggaccaaggtggaagcaaaccgactgtcggctgcaccnttctgttctnacttcctccgcc

SEQ ID NO: 214783 - DNA, 402 bp, Homo sapiens
  misc_feature: GYAE6OF01B21I3.1.34.D01.1.454.CMB.1.raw
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (389)..(389): a, c, t, g, unknown or other
  misc_feature (389)..(389): n is a, c, g, or t
  modified_base (393)..(402): a, c, t, g, unknown or other
  misc_feature (393)..(402): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgactaatttatactgtacaactagtattatacgtaccctagtggacgttcggccgaggggaccaaggtggaacgtcaaccgtactggtcgctgcactatctgtctcactcctacccncctccncacgcactcgtctggacgcggctggcaacggcanatgnnnnnnnnnn

SEQ ID NO: 214784 - DNA, 607 bp, Homo sapiens
  misc_feature: GYAE6OF01BTL74.1.34.D01.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
  modified_base (400)..(400): a, c, t, g, unknown or other
  misc_feature (400)..(400): n is a, c, g, or t
  modified_base (449)..(449): a, c, t, g, unknown or other
  misc_feature (449)..(449): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctcctgtctgcatctattgganacagagtcacatcacttgccggnagtcaggccatcagcgtattcttagccttggttncagcaagaaaccgngggcgacgcccctanagtactcgtagtctatgggtnactatccagtattcggacgtaagggtcgggtacccagtccgaaggttcaggtcggctaggtcgctaagttcgtagggactaggtacttacaccgttnacctaactatcaaggtccagtcctaggacctacgtacctaggaaatttntttacgaactttaattttaacgttaccgtgttaacctaaacgttagtttaacttaacgttacccgtaacccgttaggtccggtaaccgttccgggacggtaacggggaacctaagggtcgaaacgtccgtaaaccgtagtgggtacgtgtaccgtacg

SEQ ID NO: 214785 - DNA, 906 bp, Homo sapiens
  misc_feature: GYAE6OF01C199O.1.34.D01.1.454.CMB.1.raw
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccattccctccctgtctgctactctagttgganacagagtcaccatcacgttcggccgggcgagtcgacggccaatcgagcgtatttcgtttacgccgttggttcgcagacgaagaaacccgnggggaccgaccgccccctagaacgtacgttaccgtagttcgtagtcggtacgaccaagtaccgtaagtaacgtttcggaaccgggtaacgggggtttaccggggtacccctaaaggttccccggtaaaggggtttccgtaagggtcgggtacctaagggtttcggaccgttaaggttacccggtagggggaacctaaggttaactttaacccgtaccgttacctaaccttaaaccgttacgttaccgaacggacctaaccgggtcccgtacggaccgtaaccgggtaccgttaaggttaaaacgtttttcgtttttaacgtaaaccgtttttaaaacgtttttaacggtttaccgttaacggtttaaaacccgttaaaacgtttaacggtttttaaaacccttaaccggttttaaaaccccgggtttaacccccggtttaaacggggtttaacccgggttaacccgggttttaccccgggggaaacccgggttaaacgggggggtaaacccccgttaaagggggttaaaccggggtaaacccggttaaaccccggtaaaacccgggttaacggttaccgggttaaccggtacccggtacccgtaaaccccg

SEQ ID NO: 214786 - DNA, 394 bp, Homo sapiens
  misc_feature: GYAE6OF01BLORF.1.34.D01.1.454.CMB.1.raw
  modified_base (385)..(394): a, c, t, g, unknown or other
  misc_feature (385)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatacgtacccctagtggacgttcggccaggggaccaggtggaagtcaaccgactgtggctgcacatctgtcttcatcctcccgcatctgaacgcactcgtctgagcgggctgggacaggcgcagtagnnnnnnnnnn

SEQ ID NO: 214787 - DNA, 724 bp, Homo sapiens
  misc_feature: GYAE6OF01BBFN3.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtctccatccctccctgtctgcatctattggagacagagtcacatcacgttggccgggcgagtcaggccatcagtcgtacttactttagccgtggttcgcgacgcgaacggaaaccgagggaccgacgcccctagacgtacgttacgtacgtctaagtcggtacgactactccgtagtagtttcggacggtaaggggttcgggtaccctagttcccgacggtttcaggttcggacgtaggtcgacgtacgtcggtagggaactagtaacttaccgacttccgtactaacgttactacgagtacacggtcctaggtaccaacgttccgttaagtaaacgtttacgttttacgtaacttaacgttttttaacgttaaccgtagttaaccgtaaacgttaagtttaacgtttaaccgttaacccggttaacccgtttacgggttacccggggtaaccggtttaccggggaaccggtaaacgggggtaaccgtaaacggggttacgaaaacggttacccgaaaccgggttaacgttcggggttacgtaccgtcggtaacccg

SEQ ID NO: 214788 - DNA, 894 bp, Homo sapiens
  misc_feature: GYAE6OF01D2QLO.1.34.D01.1.454.CMB.1.raw
  modified_base (197)..(197): a, c, t, g, unknown or other
  misc_feature (197)..(197): n is a, c, g, or t
  modified_base (344)..(344): a, c, t, g, unknown or other
  misc_feature (344)..(344): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattcgacccagtctccatcctcctgtctgcatctagtgganacagacgtcacctatcacgttcggccggggcacgtcgacggccagttcgagtcgtatttcgtttacgccgttggttcgacacgacgaaacgaaaccgtacggggaccgaccgcccctagacgtactaccggtagtcgtagtcgggtnacctacgtaccgtagtaacgttcggaccggtaaggggttccgggtaccctaacggttacccgtaacggtttcgtaacgggtcgggactaagggttccgtacctaacggttccgggtaacggggtaacgtaaaggtttaaccctttaacccgtaacccgtttaccgtaaccgttaaccgtttaacgtaccgaaccgggttacctaaccgggtccccgttaaggacccccgttaagggtccccgtttaagggtaaaccgtttttaacgttttttacgaaaccgtttttaacgtttttaaccgttaacccgtttacgttaaaccctttaaacggtttaaacgtttttaaccgttttaaaccggttaacccccggtttaaccccggtttaaaggggttacccgggttaaacccggggttcccggggtaaacccgggttaaacgggggtaaacccgggtttaagggttaaacccggggtaaaaccggttaaccccggtaaaacccgggtttacggttaccggggttaaccttcccggttaacggtaaaccccccg

SEQ ID NO: 214789 - DNA, 409 bp, Homo sapiens
  misc_feature: GYAE6OF01A5FIS.1.34.D01.1.454.CMB.1.raw
  modified_base (227)..(227): a, c, t, g, unknown or other
  misc_feature (227)..(227): n is a, c, g, or t
  modified_base (393)..(393): a, c, t, g, unknown or other
  misc_feature (393)..(393): n is a, c, g, or t
  modified_base (398)..(409): a, c, t, g, unknown or other
  misc_feature (398)..(409): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtnttttgactaattttattactgtcaacagttattatacgtacccctaggtcggtacgttcggccgagggggaccaaggtggaagtcgaaccgactgtcggctgcaccatctgtcttcattccttcccgcatctgaacgctactcgtctgacgcggctggcaaggcgnatagnnnnnnnnnnnn

SEQ ID NO: 214790 - DNA, 639 bp, Homo sapiens
  misc_feature: GYAE6OF01B14XE.1.34.D01.1.454.CMB.1.raw
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccgggcgagtcgacggccatcagcgtattcttagccttggttncgagcaagaaaccgngggcgacgcccctagagtactcgtagtctagtggtgcatccagtagtgacgtaagggtcgggtcccagtccgtaggttcaggtggacctaggtcgactaagtcggtagggaacaggttaacttaccgtacttcgtaaccaacttacgtacgacgtcacgtcctacgacacgtccgtaagtaacgtttagttttcgaacctttaaatttttacgttaactacgttaacaaacctttaagttactttacgtaaacccggttaaccccgttagggtacggttaaccggttacccgggaccggaaacggggtaacgtaacgggtacgtaacgtacccgtaaacccgtagtggtacgcgttcgaaccg

SEQ ID NO: 214791 - DNA, 645 bp, Homo sapiens
  misc_feature: GYAE6OF01DLHYR.1.34.D01.1.454.CMB.1.raw
  modified_base (102)..(102): a, c, t, g, unknown or other
  misc_feature (102)..(102): n is a, c, g, or t
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggcctcccaggtaccagctgtgacatccaattgacccagtctccatcctccctgtctgcatctatggagacagagtcaccatcacttgccggnagtcaggccatcagcgtattcttagcctggttgcagcaagaaaccngggccgtacgcccctnagatcgtagtctagtggtgcatccagtaacttgacgtaagggtcgggtcccagtcccgtaggttcaggttcggctaggtcgactagtacgtggggaactaggtaacttaacacttacctacgaactactacaagtccacgtacctgaccgtaacgtccgttagtaaacgttacttttagaacctttaaattttacgttaacgttacgttaacctaaacgttaagttaacttacgttaacggttaaccccccgttagggttacggtacccggtttaccgggacccggtaagggggaacccgtaaaggggtaggtaaaccgtaccgtaaacccggtaacgttggtacgggtcgtcggtaacccg

SEQ ID NO: 214792 - DNA, 514 bp, Homo sapiens
  misc_feature: GYAE6OF01DDMSE.1.34.D01.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (472)..(472): a, c, t, g, unknown or other
  misc_feature (472)..(472): n is a, c, g, or t
  modified_base (477)..(514): a, c, t, g, unknown or other
  misc_feature (477)..(514): n is a, c, g, or t
tcagacgagtgcgtcacgaccggtgctcgatttagatcgtctgtgttgggtttgggagtcaggccatcagcgattctttagcctggttgcagcaagaaaccagggcgagcccctcagatcgtagtctatggtgcatccagattgcaaggtggggtcccatccaggttcaggtggcagtgcatcgtgggacagtattacactctcattancagcagcctgcagcctagaagtnttttgacttaattttatactgtacaatagttattaataccgtacccctaggtcggtacggttccggccggaagggggaaccaaggggttacggaactaccgaaaccgtacgttggtcggctcggacaccctatcgtagttcttacgtacttaccctcccccaccttccctacgaccgtcctacgtccgttcgtaacggccgggtccgggtcgtacgggacgaacgggtcgacgtaagtgngcagnnnnnnnnnnnnnnnnnnnnnnnnnnnnnnnnnnnnnn

SEQ ID NO: 214793 - DNA, 490 bp, Homo sapiens
  misc_feature: GYAE6OF01BFPLC.1.34.D01.1.454.CMB.1.raw
  modified_base (255)..(255): a, c, t, g, unknown or other
  misc_feature (255)..(255): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaaggtgggtccatccaggttcagtgcattgcatctgggacagattacactctcactatcagcagcctgcagcctgaagtattttgactaatttattactgtacaacagttattatacgtaccctacgtggacgttcggccaaggaccaaggtgaatcaaacgacgtgtgctgcaccgatcgtgtcttactactccttcccgaccc

SEQ ID NO: 214794 - DNA, 554 bp, Homo sapiens
  misc_feature: GYAE6OF01APYKY.1.34.D01.1.454.CMB.1.raw
  modified_base (285)..(285): a, c, t, g, unknown or other
  misc_feature (285)..(285): n is a, c, g, or t
  modified_base (366)..(366): a, c, t, g, unknown or other
  misc_feature (366)..(366): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacgttgccgggcgagtcaggccatcagcgattctttagcctggttgcagcaagaaaccgagggcgacgccccctnagactcgtaagtctagtggtgcataccagtacttggacgtaaggggtcgggtacccactccgaggttcaggtggctgtcgngatccgtgggacagtacttacacttactcactatcagcacgcctgcacgcctagtaagttatttagaactttaatttaacgtctagtacctaatacgttattagtaacccgttaccgtaggttcgtacggttcgggacgacggggaactagggtagacgttaccgaaccgtagtaggcgagtgtaacc

SEQ ID NO: 214795 - DNA, 674 bp, Homo sapiens
  misc_feature: GYAE6OF01EE8UB.1.34.D01.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (471)..(471): a, c, t, g, unknown or other
  misc_feature (471)..(471): n is a, c, g, or t
tcagacgagtgcgtcacgaccggtgctcgatttagatcgtctgtgttgggtttgggggagtcagaccctgtcaggacacagaatggacatgagggtccccgctcagctcctggggctcctgctgctctggctcccaggtaccagctgtgacatccaattgacccagtctccatcctcctgtctgcatctattgganacagatcaccatcacttgccggcgagtcaggccatcagcgtattcttagccttggttncagcaacgaaaccgnggcacgcccctnacgntcggtagtctagtggtcactacttaccgagtacttggaccgtaaggggtccgggtaccccagttacccgtagggtttaccgaagggtcgggtacctaaggttcgacgtaacgtttcggtaacgggaacctaaggttaactttaacctaccttacctactaacgttactacgaacgtcaacgtcccnggtaccacgtccgttagtaacgtttcttttaacgactttaaatttcgttaactcggtaacctaagttaattacgttaactacccgttaccgttacggtacggtacccggttccggaaccgggtaacggggtaaccgttaaggggtaacgaacggtaacccgaaaaccgggttctacgggtacggtcctaccggtctaaacccg

SEQ ID NO: 214796 - DNA, 664 bp, Homo sapiens
  misc_feature: GYAE6OF01BK4K4.1.34.D01.1.454.CMB.1.raw
  modified_base (282)..(282): a, c, t, g, unknown or other
  misc_feature (282)..(282): n is a, c, g, or t
  modified_base (424)..(424): a, c, t, g, unknown or other
  misc_feature (424)..(424): n is a, c, g, or t
  modified_base (455)..(455): a, c, t, g, unknown or other
  misc_feature (455)..(455): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctagttggagacagagtccaccatccacgttcggccgggcgagtcaggccatcgagcgtatttcgttagccttggtgcagcaaggaaaccgngggccacgcccctgagtatcgtagtcgtagtggtcgactacgtaccagtacgttggacgtaaggggttccggtaccctagtcccgtaggttcgaggttcggactaggtcgactacgtcggagggaactaagtactttaaccnccgttctaccgtaacttactacgacgtaccncgtccctaggacctacggtaccttaaggtaacgttttagtttacgaactttaaatttttacgtacctaggttaaacctaaacgttacgttaatttaacccgtaaccggttaccccgtaggttccggtaaccggttcgggacccggtaaggggtaaccctagggtaacgaacgttaaccgaacggtacgtagggtcgtccgtacgtaccc

SEQ ID NO: 214797 - DNA, 833 bp, Homo sapiens
  misc_feature: GYAE6OF01EQZ7T.1.34.D01.1.454.CMB.1.raw
  modified_base (673)..(673): a, c, t, g, unknown or other
  misc_feature (673)..(673): n is a, c, g, or t
  modified_base (699)..(699): a, c, t, g, unknown or other
  misc_feature (699)..(699): n is a, c, g, or t
  modified_base (718)..(718): a, c, t, g, unknown or other
  misc_feature (718)..(718): n is a, c, g, or t
tcagacgagtgcgtcacgaccggtgctcgatttagatcgtctgtgttgggtttgggagtcaggccactcagcgattctttagcctggttgcagcagaaaccagggcgagcccctcagatcgtagtctatggtgcactcgagtattgcgtaagggtcgggtccagttccgtaggttcaggtggcagtgcatcgtggacagtattacgactctacactatccgaggccagcctagcacgtcctagaacgtttagttttcgacttaagttttacttaccgtcgtaacgtaaacttaggtttaactttaacgttaaccgtttaacccccttagggttacgggttaacccggtttccggggacccgggtaacgggggaacccggttaaaggggttaaccggggtaaaccggttacccgtaaaacccggtaacggtttcggtacgggttaccgtacgacccgtaaccttacgtttaccgttacggtttacctttacgtaaccgtttaccccgtttacccccggtaccttaacgtttacccggtaacggtaaaacccgtccccgtttaaaccgtttcccgggtttaacggtaaccggggtaacggggtcccggggttaaccggtttacccgggaaaccgggttaaacccggggtcccgtaaccgttaacggttaaacggngtaaccgttgaacgccgtagtcgtanacgtacgtgacgtcgtcgngtacgtacgtacgtacgtacgtacgtacgtacgtacgtacgtacgtacgtacgtacgtcgtaggtacggtacgtacgtacggacgtacgtacggtaggtacggtaggtcggtacg

SEQ ID NO: 214798 - DNA, 613 bp, Homo sapiens
  misc_feature: GYAE6OF01CO4XX.1.34.D01.1.454.CMB.1.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtctccatcctccctgtctgcatctattggagacagagtcacatcacttggccggcgagtcaggccatcagcgtattctttagcctaggttgcagcaagaaccgnggcgacgccctanagtntcgtagtctagtcggtagactactccgagagttacgacgtaacgggtcgggtaccacgttccgtaggttcgaaggtcggacgtagtcgactagtcgtacgggactagtacttaccactccgtactactagtacagtacgacgtacctcggacaacgtccgtaaggtaacgttacgtttacgtactttaaatttacgtttaccgtagttacgtaaattacggtttaattaacgtaaccgttacccgtaacggttcggtaacggtcggacggtaacgggaaacgtaggtacggaagtaccgtaaaccggataggtcgtgtcgtaaccg

SEQ ID NO: 214799 - DNA, 592 bp, Homo sapiens
  misc_feature: GYAE6OF01DB9VZ.1.34.D01.1.454.CMB.1.raw
  modified_base (337)..(337): a, c, t, g, unknown or other
  misc_feature (337)..(337): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggtgcagcaagaaaccgagggccgacgcccctgagatcgtagtctagtggtgcatccagattgacgaagggtcgggtcccatccgaggttcaggtggcagtgcagttcgnggacagtactacactctacactatcagcacgcctgcgtacgcctagtaacgttatttgaccttaatttacttactacgtactaacgtagttaacttacgttaccgtaccccgttaacggtcggtacgggttccggaccggaacggggtaaccgtagggttacggaaacgttaccgaaaccggtaacgttcggtacggtctacgaccgtaacctagttaccgttcgttaccttactaccttcccgttcccgtaccg

SEQ ID NO: 214800 - DNA, 526 bp, Homo sapiens
  misc_feature: GYAE6OF01B0OVK.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcaagaaaccgagggcacgcccctnagatcgtagtctagtggtgctatccgagtattgacgtaagggtcgggtcccagtcccgaggttcaggttggacagtcgctagtcgtagggacagtacttactactctacactatacgagcacgcctagcacgcctagaacgttatttacgacttaatttactactagtacaagtatattactacgtaccctagtcgacgttcggcgagggactaggtagaagtcgaacgactgcgctgacc

SEQ ID NO: 214801 - DNA, 660 bp, Homo sapiens
  misc_feature: GYAE6OF01B4YGM.1.34.D01.1.454.CMB.1.raw
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctattggagacagagtcacctatcacgttggccgggcgagtcacggccatcgagcgtaattcgttagccgttggttcgcagcaagaaaccgagggccgacgccccgtnagtactcgtagtctagtggtcgctactccgaagtacttcggacgtaacggggtcgggtacccacgttccgtaggttctaggtcggacctaggtcgactacgtcggtacgggaactaagaccgtttacctactacctactacttaagccgtacgacagtcccgtagcctaaggtcctaaggtaactttagtttacgaacttaagttttactaacgtacgttaacctaaagttacgttaactttacgtaacccggttaccccgttaagggtccggttaaccgggtccggaaccggtaacggggaaccgtaagggttacggaaacgtcccgtaaaacggtacgttagggaccgtcgtcggtaaccc

SEQ ID NO: 214802 - DNA, 1068 bp, Homo sapiens
  misc_feature: GYAE6OF01D46WR.1.34.D01.1.454.CMB.1.raw
tcagacgagtgcgtcacgaccggtgctcgatttagatcgtctgtgttgggttggcatggacactgagggtccccgctcagctcctggggctcctgctgctctggctcccaggtaccagctgtgacatccaattcgacccagtctccactcctccctgtctgctatctagtggagacagacgtcacatcacgttcggccgggcacgtcgacggccagtcgagtaccgtatttcgtttacgccgttggttcgacgagaccgaacgaaaccggagggaccgacgtcccctagacgtacgttcgtagtacgtagtcggtgactatccgaagtcgttacggacggtacgggttccgggtacctaacgtaccgtaggttacgaggtcgacgtaagtcgactacgtcggtacggactagtaacttactactactactaacttacacgtagaccgtaacgtccgtacggaccgtacggtaccgttaaacgggttaaacgtttacgttttaccggtaaaccttttaaacgttttttaccggttaaaccgttacgtttaaaacccgtttaaaacggtttaacgtttttaaaaccggttttaacccgtttaaaacccccggggtttaaccccccggtttaacggggtttaaccccgggggtttaaaaccccccggggtttttaccccggggggaaaaaaccccggggggttaaacccccgggggggtttttaaaaacccgggggttaaaaccccggggggttttaaaaccggggggttaaaaaccccggttttaaaaaaccccccggggtaaaaacccggggttttaaaccgggttttaaaccggggggttaaaccccgggtttaaacccccggggtttaacccccgggttaaaaacccccgtttaaaaccccccgggttttttaaaacccggggtttttaccccccccgggggttttttaaaaacggtttttttttacccccccccgttaaaacccggggttttttaaaaccccccccgggtttttttcccccccgggttaaaaccccccccggggttttttaaaaaccccccggggg

SEQ ID NO: 214803 - DNA, 784 bp, Homo sapiens
  misc_feature: GYAE6OF01DAH01.1.34.D01.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctnagactcgtagtctagtggtgacatccagagttgacgtaagggtcgggtcccagtcccgaaggtttcaaggtcggacagtcgctagtcgtagggactagtaactttaccgaccttcgtactaacttactccaagtaccgacgtccctagccgaacgtcccgttaaggtaaacgtttacgttttttacggaactttaaaacgttttttacgtttaaaccgttacgggttaccctaaaacgttaacggtttttaaacgttttaacgtttaaacccgggtttaaaccccccccgtttaaggggttacccgggggtttaaacccgggttttccccgggggtaaaccccggggttaaaacgggggggggttaaacccccgttaaaaagggggggtttaaaccccggggggttaaaaacccggtttaaccccgggtaaaaaacccccggggtttaaaccgggtttcggggtttaaccggggtccccggtttaacgggtaaaccccccg

SEQ ID NO: 214804 - DNA, 437 bp, Homo sapiens
  misc_feature: GYAE6OF01CM13B.1.34.D01.1.454.CMB.1.raw
  modified_base (317)..(317): a, c, t, g, unknown or other
  misc_feature (317)..(317): n is a, c, g, or t
  modified_base (409)..(411): a, c, t, g, unknown or other
  misc_feature (409)..(411): n is a, c, g, or t
  modified_base (413)..(437): a, c, t, g, unknown or other
  misc_feature (413)..(437): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctgaagtatttgactaatttatactagtacaactagtattactacgtaccctaggtggtacgttcggcgtaggggaccaaggtgaagtcaacgatgngctgctacatctgtcttcactccttcccgctatctacgacgtctacgtcgtcgtgacggtcgggtctagggaccgtaaggccgtacagtagnnngnnnnnnnnnnnnnnnnnnnnnnnnn

SEQ ID NO: 214805 - DNA, 638 bp, Homo sapiens
  misc_feature: GYAE6OF01B9XIO.1.34.D01.1.454.CMB.1.raw
  modified_base (304)..(304): a, c, t, g, unknown or other
  misc_feature (304)..(304): n is a, c, g, or t
  modified_base (409)..(409): a, c, t, g, unknown or other
  misc_feature (409)..(409): n is a, c, g, or t
  modified_base (628)..(628): a, c, t, g, unknown or other
  misc_feature (628)..(628): n is a, c, g, or t
tcagacgagtgcgtcacgaccggtgctcgatttagatcgtctgtgttggggtttgggggagtcagaccctgtcaggacacagcatggacatggacgggtcccccgctcagctccgtggggcctcctgctgctcgtggcctcccgaggtaccagctgtgacactaccaattcgacccagtcctccactccctccctgtctgcatctagtggagacagacgtccacatcctacgttcgggccgggcgagtccgacggccatcgagcgttattcgttagccgttggtcgcacgacgaacggaaccgngggacgacccggtccctagagtacgttcgtagtcgtaggtgtcgactactcgagtaggtcgacggtacggggtccggtaccaacgtcggaaggtcgaggtcgganaggtgtacagttcggaaggataactaccgttacactccgtaactataacgcgtacgacctggaccctgggaccctaggtacgttaagtaacgttatttacgaactttaactttaacgtctacgtaacaaatttcgtaacttactaccgttacgtaggtaccgggtacgtcgggaaccgtaaggggactagggtaacaaccgtagtaccgtagtccggcncgtcgtaacc

SEQ ID NO: 214806 - DNA, 466 bp, Homo sapiens
  misc_feature: GYAE6OF01CCAYR.1.34.D01.1.454.CMB.1.raw
  modified_base (358)..(358): a, c, t, g, unknown or other
  misc_feature (358)..(358): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
  modified_base (449)..(466): a, c, t, g, unknown or other
  misc_feature (449)..(466): n is a, c, g, or t
tcagacgagtgcgtcacgaccggtgctcgatttagatcgtctgtgttgggtttgggagtcaggccatcagcgattctttagcctggttgcagcagaaaccagggcgacgcccctcagatcgtagtctatggtgcatccagattgcgaagggtcggggtcccagtcccaggttcagtggcagtgcatcgtgggacagtattaccactctcaactatcagcagcctgacacgtcctaggtaagttattttgacttaaattttacttaccgtagtactaaactagttaattactaaccgttaccccgtaggtcggtacgttcggaccggagggaccagggtcgaactacgaacgacgtggngctgacactatctcgttcctactacttcccttaccccaccttcctacncctcactcgtcgtggacggcggcgtggacgaggcncgatacgnnnnnnnnnnnnnnnnnn

SEQ ID NO: 214807 - DNA, 612 bp, Homo sapiens
  misc_feature: GYAE6OF01B6XAQ.1.34.D01.1.454.CMB.1.raw
  modified_base (278)..(278): a, c, t, g, unknown or other
  misc_feature (278)..(278): n is a, c, g, or t
  modified_base (389)..(389): a, c, t, g, unknown or other
  misc_feature (389)..(389): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattctttagcctggttgcagcagaaccagggcgagcccctnagatcgtagtctagtggtgcatccaagtagttgacgaagggttcgggtaccatcccgaggttccaggtggactaggtgcatcgtggaacagtactacgctctacacttacncacgctacgcctcggactacgcccgtagtaaaggtttattttacggaactttaaattttacgttaaccgtcggttaactaaacgttagtttaacttaaccgttaccgtaaccccgttaggttaccggacccggtttacggggacccgtaaagggggtaaccccaaagggggttccggtaaacgttccgtaaaacccgagttacggtacgggcttacggacccg

SEQ ID NO: 214808 - DNA, 690 bp, Homo sapiens
  misc_feature: GYAE6OF01CKUKV.1.34.D01.1.454.CMB.1.raw
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatccctccctgtctgcatctattggagacagatcaccatcacgttggccgggcgagtcgaggccatcgagtcgtatttcggtttacgccgttggtgcagaccaacggaaaccgagggccgacgcccctgaagacttcggtagtctagtgggtcnctaactccgaagagttggacggtaggggtcgggtcccagttccgtagggtcaggtggactaggtcgctagtcgtaggacagtactacctctctacactactcacgccagtccgtagaccgtacggtaccgtaagttaaacgtttactttacgaacttttaagttttaacttaccgttaccgtaactaacgttaacgttaattttaaccgtaacccggttaaccccgtaggggttacccgttaccggggtaccggtaccgggtaaacggggtaccggtagggttaaaccggtacggtaaacccggaccggttaacgtcgggggtacctcgggttaccaccgaccgttcgttacgtttcgtacccttatacccgttccccgtccccgtaacg

SEQ ID NO: 214809 - DNA, 740 bp, Homo sapiens
  misc_feature: GYAE6OF01BU9H9.1.34.D01.1.454.CMB.1.raw
  modified_base (103)..(103): a, c, t, g, unknown or other
  misc_feature (103)..(103): n is a, c, g, or t
tcagacgagtgcgtcacgaccggtgctcgatttagatcgtctgtgttgggtttgggggagtcagaccctgtcaggacacagcatggacatggacgggtccccnctcagctccgtggggctcctgctgctcgtggcctcccgaggtaccagctgtcgacactaccaaattcgaaccctagtcctaccactccctcctgtctgctatctagtggagacagactcacatcacgtcggccggtgacgtcacggacctatcgagtcgtactttcgttacgccgttggtcgacgtaagaccgaacggaaacccggcggggaccgacccgacccctagaacgttacgttaccggtagtctaggttcggtcgactacgtccgtaaggtacgttcggaacggttaacggggtccggtacctacgtaccggtacggtacgtaggtcggtacgtacggtgaccgttaaggtcccggtaggggaactaacgttaaccttaaccgactttaccgtactaactttacgaccgtaacgtccgaacgtcccgtgtaccgaaccgttacgtaagggttaactttacgtttacgtaaactttaacgttttacgtacctagttaaaccgttaaacgttagtttaaccgttaccgttaaacccggtacccgttaagggcccgttaacggggttacccggaacggtaacggggaactaacgggtcgaaacgttacccgaacgtagtcgacgtcgtccgaac

SEQ ID NO: 214810 - DNA, 724 bp, Homo sapiens
  misc_feature: GYAE6OF01B0OMK.1.34.D01.1.454.CMB.1.raw
  modified_base (102)..(102): a, c, t, g, unknown or other
  misc_feature (102)..(102): n is a, c, g, or t
  modified_base (200)..(200): a, c, t, g, unknown or other
  misc_feature (200)..(200): n is a, c, g, or t
tcagacgagtgcgtcacgaccggtgctcgatttagatcgtctgtgttgggtttgggggagtcagaccctgtcaggacacagcatggacatgacgggtccccnctcagctccgtggggctcctgctgctctggctcccaggtaccagctgtgacatccaattcgacccagtctccatccctcctgtctgcatctattgganacagacgtcaaccatcacgttcggcccgggcagtcaggccatccgagcgtatttcgtttagccgttggttcgcagacaacggaaaccgcgggaccgacgcccctagacgtacttcggtagtctagttggacgctactccgaagtacgttacggacggtaacggggttccggtacccaacggttcccggtacggttcgtaacggtcggacgtacgggttcacgtacgttaccgggtacgggaactaacgtaactttaccgaaccttactaccgttaactaaccgtacgaacgaccgtaaccgtccgtacgaccgtaacgtccggttaaggtaacgttttacgtttacgtaacttttaacgttttaacttaccgttaacgttaactaacgttaacgtttaacttaaccgttaaccgttaccccggtaggttaccggtaccggttaccgggaaccgggtaacgggtaacgtacgggacggtaaaccgtaaccgtaaccggtacggttcggtacgtcgtcgtaacccg

SEQ ID NO: 214811 - DNA, 549 bp, Homo sapiens
  misc_feature: GYAE6OF01BVBRZ.1.34.D01.1.454.CMB.1.raw
  modified_base (199)..(199): a, c, t, g, unknown or other
  misc_feature (199)..(199): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattcgacccagtctccatcctccctgtctgcatctattgganacagagtcaccatcacttcggccgggcgagtcaggccatcagcgtattctttagccgttggttcgcagacaaggaaaccgagggcgacgcccctagagtatcgtagtctagtggtcacatccagtacttggacgtaggggtcgggtcccagtcccgtaggttcaggtcggcaggtcgctagtcgtagggactagtacttacnctctcatntacgncacgctgcacgtctagaagtttntttgactttaatttactacgttagtactaattattacttacgtaccgttacccgtaggtcgtacggttcggacgtagggactagggtgaacgtacaacgtatgcgtctgacc

SEQ ID NO: 214812 - DNA, 689 bp, Homo sapiens
  misc_feature: GYAE6OF01CS59G.1.34.D01.1.454.CMB.1.raw
  modified_base (182)..(182): a, c, t, g, unknown or other
  misc_feature (182)..(182): n is a, c, g, or t
  modified_base (207)..(207): a, c, t, g, unknown or other
  misc_feature (207)..(207): n is a, c, g, or t
  modified_base (250)..(250): a, c, t, g, unknown or other
  misc_feature (250)..(250): n is a, c, g, or t
tcagacgagtgcgtcacgaccggtgctcgatttagatcgtctgtgttgggtttgggcatggacatggacgggtccccgctcagctccgtggggcctcctgctgctcgtggcctcccaggtaccagctgtagactactccaattcgacccagtcctccatccctcctgtctgcatctatgganacagatccacatcacgtcggccggngagtcaggaccatcaagcgtattcgtttacgccgttgggtacncacgacaaacggaaccgaggggaccaaccgcccctagaacggtaacgtcgtaagtcgttagtcgggtacactaacgtccgaagtacgttacggacggtaacggggtccggtaccctagtacccgtagggttacaagggtcgggactaagtcgacgtaacgttcggacgggtaactaggtaaccttacgacctacgtactaagactcaagcacgctaggactagacctagaactttattacgactttaagttacttagtacgaactaagtagttaacttaccgtaacccgttaacctacgggttagggtaacccgttcgggaaccggaacggggtaacccggaagtaacgggtaaacgaaccgggaaacctaagggttcgaacggtaccacgtaccgaaaccttgttctacgttactaaccttccgtcccttcccgaacg

SEQ ID NO: 214813 - DNA, 831 bp, Homo sapiens
  misc_feature: GYAE6OF01DQH60.1.34.D01.1.454.CMB.1.raw
tcagacgagtgcgtcacgaccggtgctcgatttagatcgtctgtgttgggttgggggagtcagaccctgtcaggacacagcatggacatgacgggtccccgctcagctccgtggggcctcctgctgctctggctcccaggtaccagctgtgacatccaattcgaacccagtcctccatccctccctgtctgctatctatggagacagagtcacctatcacgttcggccgggcgacgtcgaggcctagtcagtcgtactttcgttacggccgttggttcgacacgacaaacggaaaccggcggggaccgacgccccctagaagtacgtcggttacgtccgtaagttcgggtactaccaacgttaccgtaaggtacttacgggaccggtaaaggggggttccgggtacccctaaggttcccggtaaggtttccgtaagggtccggacgtacggtcggtactacggttccggtacgggaacttacgtaacgttaaccctaccttcctaacctaacttacgtaccgaacggtacgtacccgtccgtaggtaccgtaccgggtacgtttaaggttaacggttttacgtttttacgaaccgttttaaactttttacgttaaccgttacggttaaaccttaaacgttaacgtttaacgtttaaccgttaacccggttaaccccggttagggttaccggggttaacccgggttaccccggggtaaccgggtaaacgggggggttaaaccccgtaaagggggttaaaaccgggtaaccgttaaacccccggtaaaccgggttaacggttccgggttaacgggtcccgtccggtaaacccg

SEQ ID NO: 214814 - DNA, 543 bp, Homo sapiens
  misc_feature: GYAE6OF01EINT7.1.34.D01.1.454.CMB.1.raw
  modified_base (499)..(499): a, c, t, g, unknown or other
  misc_feature (499)..(499): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgcgaaggtcggggtcccaagtccaggttcaggtggcagtgcatcgtgggacagacttacactctcactatcagcagcctgcagccgtagaacgtattttagacttaagtttacttacgtgtacaactagttaattactacgtaaccccttaggtcggtaccgttcggaccgaggggaccaagggtaggaagtaccgaaaccggacgtggtcggntcggccacctagtccgtcgttcctactcttcccgttcccgtacc

SEQ ID NO: 214815 - DNA, 596 bp, Homo sapiens
  misc_feature: GYAE6OF01D9PFZ.1.34.D01.1.454.CMB.1.raw
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
tcagacgagtgcgtcacgaccggtgctcgatttagatcgtctgtgttggggtttgggggagtcagaccctgtcaggacacagcatggacatgagggtccccgctcagctccgtggggcctcctgctgctctggctcccaggtaccagctgtgacatccaattgacccagtctccatcctccctgtctgctatctattggagacagagtcacatcacgttggccgggngagtcaggccatcagcgtatttcttagccgtggttcgcagacaacgaaaccgaggggccgacgccccctnagtacgtcgtagtctagtggtncatcagtattcgacgtaagggtcgggtacccagtccgaggttacaggtcggcaggtcgactagtcgtagggaactagtaacttacgactctacaactatacagtcacgcctagacacgtcctagaacgttactttagacttaaatttacgttactagtaactaaactagtttaattacgtaaccgttaaccccgtaggttcggtaccggttcggaccggaaggggaccgtaagggtaggtaacgaaccgtaacggaaacttgggacgtgtcgtaacc

SEQ ID NO: 214816 - DNA, 568 bp, Homo sapiens
  misc_feature: GYAE6OF01C4CMV.1.34.D01.1.454.CMB.1.raw
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatccagcgtattctttagccttggttgcagcaacgaaaccgaggggcgacgcccctnagactcgtagtctagtggtcgcatccagtattgacgaaggtcgggtacccagtccgaggttcaggttcggctaggtcgacgtagttccggtagggaactagtacttacacttactactactatcagacacggtccctggccagccttagtaagttacttttgacttaatttacttactagtacaacgtagttacttacgtaccgtacccgtaggtcggtacgttcggaccgtaggggactagggtacgaacgtcgaaaccgtagtggtcgctggtacc

SEQ ID NO: 214817 - DNA, 614 bp, Homo sapiens
  misc_feature: GYAE6OF01E02WS.1.34.D01.1.454.CMB.1.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (605)..(605): a, c, t, g, unknown or other
  misc_feature (605)..(605): n is a, c, g, or t
tcagacgagtgcgtcacgaccggtgctcgatttagatcgtctgtgttggggtttgggggagtcagaccctgtcaggacacagcatggacatggagggtccccgctcagctccgtggggctcctgctgctctggcctcccaggtaccagctgtgacatccaattgacccagtctccatccctccctgtctgcatctatggagacagagtcaccatcacttgccgggcgagtcgaggccatcagcgtattctttagcctggttgcagcaagaaaccgagggcgacgcccctnagatcgtagtctagtgggtncactccagtagttgacgtaaggggtcgggtacccagtccgtaggttacaggtggctagtgctatcgtagggactagatacactctactactatcgagccagcctagacgacgtccgtaagtaacgttattttcgaactttaaactttacttaacgtcgtaactaacgtaagtttaactaacttaccggtaaccccgttaggttacgggtaaccgttccgggaccggtaagggggaaccgtaaacggggttacggaaacggttacccgaaacccggtaaacggttggtcggtccgnggtaacccg

SEQ ID NO: 214818 - DNA, 647 bp, Homo sapiens
  misc_feature: GYAE6OF01BPWS7.1.34.D01.1.454.CMB.1.raw
  modified_base (221)..(221): a, c, t, g, unknown or other
  misc_feature (221)..(221): n is a, c, g, or t
  modified_base (290)..(290): a, c, t, g, unknown or other
  misc_feature (290)..(290): n is a, c, g, or t
  modified_base (635)..(635): a, c, t, g, unknown or other
  misc_feature (635)..(635): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctatggagacagacgtcacatcacgttgccgggngagtcaggccagtcagcgtacttcgttagcctggttgacagacaacgaaccgagggcgacgtcccctanagtactcgtagtctagtggtcgactataccgagtattcggactaacggggtccggtacctaagtcccgtaaggttccgaaggttcggacgtacggtacgaccgtagttacggtacggggactaaggttaacgttacctaaaccgttcgttaccaacttagtaccgagtaccgacgtcctaggcctaacggacgtagtaagtttatttcgtaatttatttataccgtagtaccgtaatacgttaattaccgtaaccgtacccgtagttaccggtaccgttcgggtaccgaacgggttaccgaagggtaggtaaacggtaccgtaaaccggtacgtagggttaccgngtacgtaacccg

SEQ ID NO: 214819 - DNA, 690 bp, Homo sapiens
  misc_feature: GYAE6OF01BW59K.1.34.D01.1.454.CMB.1.raw
  modified_base (199)..(199): a, c, t, g, unknown or other
  misc_feature (199)..(199): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattgganacagagtcaccatcacttcggccgggcgagtcaggccatcgagcgtatttctttagcctggttgcagacaaggaaaccgagggcgacgcccctgagatcgtagtctagtggtcnctactccagtattggacgtaaggggtccgggtaccctagtccgtaggttcgaggtcggacgtaggtcgctagtcgtagggaactagtaacttaccaccttctactaactacgtacgacgaccacgtcctagaccgacgtaccgttaggtaaacgtttattttacggaactttaagttttaacgttaacgtacgttaaactaacgttaacgtttaactttaaccgttaacccggttacccccgttaagggttacccgggttaacccgggttacccggggaacccgggtaacgggggtaaaccgtaacggggttaacgggtaaaaccgttacccggtaaaccggtacggttacgggtacggtacccgtcggtaaccccg

SEQ ID NO: 214820 - DNA, 672 bp, Homo sapiens
  misc_feature: GYAE6OF01EOLCL.1.34.D01.1.454.CMB.1.raw
  modified_base (205)..(205): a, c, t, g, unknown or other
  misc_feature (205)..(205): n is a, c, g, or t
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (474)..(474): a, c, t, g, unknown or other
  misc_feature (474)..(474): n is a, c, g, or t
tcagacgagtgcgtcacgaccggtgctcgatttagatcgtctgtgttgggtttgggggagtcagaccctgtcaggacacagcatggacatgacgggtccccgctcagctccgtgggctcctgctgctctggctcccaggtaccagctgtgacataccaattcgacccagtcctccactccctcctgtctgctattctagttgganacgagacgtacaccattccgacgttcggccgggacgtacgtcgacggccagtcgagtcgtatttcgttacgccgttggtcncagacaaacgaaccgnggccgaccgccctagagtacgtcgtagttctagtcggtcgacagtaccgagtagttacggacggtacggggttcccggtacctaagttcccggtaaggtttcgaggttcggacgtaggtcgacgtacgtcggtacgggaactagttacttaaccgaccttctactacttacncgacgactacgtccgtaggtccacgtacgtagtaacgtttgtttagaactttaagtttactacgtacgtaacttaagttagttaacttaaccgtacccgtacccgtggttaccgggtacgttccgggaaccggtaagggtacggtaaggttacggaaaccgtaaccggtacctaggttcggtacggtcctacgtaccg

SEQ ID NO: 214821 - DNA, 628 bp, Homo sapiens
  misc_feature: GYAE6OF01CPR1X.1.34.D01.1.454.CMB.1.raw
  modified_base (227)..(227): a, c, t, g, unknown or other
  misc_feature (227)..(227): n is a, c, g, or t
  modified_base (276)..(276): a, c, t, g, unknown or other
  misc_feature (276)..(276): n is a, c, g, or t
tcagacgagtgcgtcacgaccggtgctcgatttagatcgtctgtgttgggtttgggggagtcagaccctgtcaggacacagcatggacatggggagggtccccgctcagctcctggggctcctgctgctctggctcccaggtaccagctgtgacatccaattcgacccagtctccatcctccctgtctgcatctattggagacagagtcaccatcacttggccgggngagtcaggccatcagcgtattctttagcctggttgcagcaagaaaccgngggccgacgcccctcagatcggtagtctagtggtgcatccgagtattggacgaagggtcgggtcccagtcccgaggttcaggtcggcgtaggtgcgagtcgtagggactagtacttacgacttctacacttatcgagcacgcctgaccacgtcctaggtaacttatttacggacttaaatttattacgtagtacctaaactagttaacttactaacccggttaccccgtacgggttccgggtaaccggtttccgggacccggtaacgggggtaacccgtaaagggggttaccggtaaacggttacccgtaaaacccggtaacgttcgggtaacgggtcctacggtaaccccg

SEQ ID NO: 214822 - DNA, 645 bp, Homo sapiens
  misc_feature: GYAE6OF01COOZP.1.34.D01.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagccttaggttncagcaagaaccgngggcacgcccctanagatcgtatctagtggtgacataccagtagttcgagtaacggggtcggtaccccagttcccgtaggttcgaaggttcggactaggtcgactagtcggtagggactagtacttaaccgcttcgtacaacgttactacgaagtccaacgtcccgagtccacgtaccttaaggtaagtttacttttacgaacctttaattttaaccgttacttaaccgtacgtaaacttagtttaacttagttaacccggttacccgttagggtccggtacggttacccgggaaccggtaacgggggtaaacctaggggtaacggtaaacgtaccgtaaaccggttacgtgggtcggtaccgtcgaacccg

SEQ ID NO: 214823 - DNA, 534 bp, Homo sapiens
  misc_feature: GYAE6OF01E0GW9.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgagcccctnagatcgtagtctatggtncatccagattgcaagggtcggtccatccaggttcagtggcagtgcatcgtgggacagtattacactctacactatcagcagcctgcacgcctagaacgttattttcgacttaagttttatacgtgtacaaactagttaattactaccgtaccctaggttacggaccgtttcgggaccgtaaggggacctaagggtcggaaacgtcctaaaccgggacttggtcggccgtgtacccg

SEQ ID NO: 214824 - DNA, 741 bp, Homo sapiens
  misc_feature: GYAE6OF01AP1BM.1.34.D01.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactcctccctgtctgcatctatggagacagatcaccatcactcggccgggngagtcaggccatcagcgtattcttagcctggtcgcagcgaacgaaaccgacgggccgaaccgccccctagacgtacgtacggtagtcttaggtgggtcacgtactccgaagtagttcggaccggtaacggggttccgggtacccctaagttacccggtaggttcggaggtcgggactaggtacgacgtacgtcggtacgggactaacggttacttaccgacttcctacgtaacttacgacgtacgaccgtacgtcccgtagaccgtaccggtactttaagggaaacttttcgtttaaccggtaacttttaaagttttaaccgttacgtttacgttaaaccctaaacgtttaagtttaaccgttttaaccgttaaccccggttaacccgttaacggggttacccggttaaccgggttacccgggaaccgggtacggggttaaacggtaacggggttaacggtaaccgtaacccggtaaaccggtacggttacggtaccgggtaccgtaccgtaacccgg

SEQ ID NO: 214825 - DNA, 688 bp, Homo sapiens
  misc_feature: GYAE6OF01AFY28.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcaggaaaccaggggcacgccccctnagatcgtagtctagtggtcgcatccaagattggacgaaggtcgggtccagtccaggttcaggtggctaggtcgctatcggtagggacctaaggtactttaccaccgttctacctaactacttacgaacggctaccggtaccctggccgtaacgcccttagggtaaatttacgttttagaactttaaattttaacgttaacgttcgtaaccttaacgttaacgttaactttaccgttaaccggtttaccccccgtaagggtttaccgggtaacccgggtttacccggggacccggtaacgggggggtaaccgtaaaacgggggttaccgggtaaaaccgggttacccggtaaaacccgggtaacgggtttccgggaaccggggtccgtttaacgggtaaccccc

SEQ ID NO: 214826 - DNA, 395 bp, Homo sapiens
  misc_feature: GYAE6OF01B1ZW1.1.34.D01.1.454.CMB.1.raw
  modified_base (377)..(377): a, c, t, g, unknown or other
  misc_feature (377)..(377): n is a, c, g, or t
  modified_base (384)..(395): a, c, t, g, unknown or other
  misc_feature (384)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgcaatttattactgtcaacagtattatagtaccctagtggacgttcggccaggggaccaaggtgaagtcaaccgactgtggctgcacatctgtcttcatccttccaccctcctcacgcactctctgagcgggctgggcaagggccncatacgnnnnnnnnnnnn

SEQ ID NO: 214827 - DNA, 533 bp, Homo sapiens
  misc_feature: GYAE6OF01A5TV6.1.34.D01.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcagcgtattctttagcctggttncagcaagaaaccngggcacgcccctgagatcgtagtctagtggtncatccagattgacaaggtcggccatcaggttcaggtgcagtgctagtcgtggaacagtacttaccattctacaactatcaaggtcaaggcctgctagcctagaagttatttagacttaattttatacgtgtaactaaactagttaattacaacgttaccctaaggtggtaccgtcggacgaggggaacctaagggacggtaaatacccgaaacgtactagtcgacgtgaacc

SEQ ID NO: 214828 - DNA, 747 bp, Homo sapiens
  misc_feature: GYAE6OF01EA9KL.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctagttggagacagatccacatcacttgccgggcagtcaggccatcagcgtattctttagccgttggttcgacgacgacgaaacggaaaacccggaggggaccgaaccgtccccctacgaacggtacttaccggttaagttaccgttaaggttcgggtacgacctaacttacccgaagttagtttacggaccggtaaacgggggttccggggtacccctaaggtacccggtaaggtttccgagggttacggcgtaggtacgactaacggttcggtaggggtaacacggttaacttaaccgtaaccttcctaacaacttaacgtacaacggtcgaaccgtccgtacgaccgacgtaccgtaaggtaaagtttaattttacgaactttaaagttttaacttacgttagtaacctaaacgttaagttaacttaaccgttaccgtaaccccgttacgggtaccgggttaacgtacccgggtaccgggtaaacgggggtacgtaaacggggttacggtaaacgtaacccggtaaaccgtacgtaggtacggcgtcgtaacccg

SEQ ID NO: 214829 - DNA, 635 bp, Homo sapiens
  misc_feature: GYAE6OF01ABWRZ.1.34.D01.1.454.CMB.1.raw
  modified_base (100)..(100): a, c, t, g, unknown or other
  misc_feature (100)..(100): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (426)..(426): a, c, t, g, unknown or other
  misc_feature (426)..(426): n is a, c, g, or t
  modified_base (626)..(626): a, c, t, g, unknown or other
  misc_feature (626)..(626): n is a, c, g, or t
tcagacgagtgcgtcacgaccggtgctcgatttagatcgtctgtgttgggtttggggagtcagaccctgtcaggacacagcatggacatgagggtccccntcagctcctgggctcctgctgctctggctcccaggtaccagctgtgacatccaattgacccagtctccatcctcctgtctgcatctatgganacngatcaccntcattgccggnagtcaggccatcgagtcgtattcttagctgtncagcagaaccgngggcacgcccctagagntcgtagtctaacgtggtcactactaccgagtactttcggacgtaacggggttccgggtaccctaagtcccgtaggtttaccgaaggtcggtactagggtcaccgtaatcggtacgggaactaggtacttaccgacttcgtacacgttaacncgacgtcctaacgcccgtgaacccgtacgtaccgttaggtaacttacgttttacgaacctttaatttaaccgtaacgtgtaacctaacgttacgttaactttaacgaccgtttacccgtagggtacggtacccggttacggaccggtaagggtacctagggttaccggaaacctcgtaaaaccgtgttacggtcgtaccnggtaacccc

SEQ ID NO: 214830 - DNA, 702 bp, Homo sapiens
  misc_feature: GYAE6OF01CG671.1.34.D01.1.454.CMB.1.raw
  modified_base (271)..(271): a, c, t, g, unknown or other
  misc_feature (271)..(271): n is a, c, g, or t
  modified_base (449)..(449): a, c, t, g, unknown or other
  misc_feature (449)..(449): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattcgacccagtcctccacttccctccctgtctgctatctattggacacagagtcacctatcacgttcgccgggcgagtcgaggccatcgagcgtattcttagccgttggtcncagacaacgaaaccgagggccgacgcccctagacgtatcggtagtctaagtgggtcactactaccgaagtacgttggacggtaaagggtccggggtacccaacgttcccgtaggttacacgggtcggactacggtgcgtagttcgtagggaactagtacttactactctactacttanacgacgcacgtccaggcctacgaccgttaaggtaacgtttaattttacgaacttttacgttaactttctaacggttaaccttaaattaacgtttaacgttaacccttaaccgggttaacccccgtttagggttacgggtaacccccggtttaccggggaaacccgtaaaacgggggaaacccttaaaggggtaaaccttaaaacgaaacccggtaaaacggtaaccgttagggtaacgtccgtacgtaacccg

SEQ ID NO: 214831 - DNA, 789 bp, Homo sapiens
  misc_feature: GYAE6OF01COVZH.1.34.D01.1.454.CMB.1.raw
  modified_base (516)..(516): a, c, t, g, unknown or other
  misc_feature (516)..(516): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggcctcctgctgctcgtggctcccgaggtaccagctgtgacatccaattcgacccagtctcctactcctcctgtctgcatctagtggagacagataccactatctacgttcgggaccggacgtacgtcgacggcctagtcgaggtacgttattttaccgtttacggtccgttagggttcgaccgaacgaccgaaacgggaaaaccgcggggaccgaacccgtccccgtaagaacggttacgtccggttagtacgttaggtcgggtacactacgttaccgagttacgtaggacggtacggggtccggacctacgtcggtaggttcgaggtcggactagtcgtacgtacggtcggtagggaactagtaccttaacgcttacacgtaacttacgcgacgtacncggtcctggactacgtacgtaagttaattacgtttacgtaactttaacgtttacgtaaccttaggtaaacctaacgtttaacgtttaaacgttaccgtaaccccggttaaccccggtttagggtaccggggtttacccggttaacccggggaaacccggggtaaccggggttaaaaccgggtaaaggggtttaacccgggaaaacccgttaaacccgggtaaacccgggttaaccgggttggggaaaccccgttcggtaaccccgttaaaccg

SEQ ID NO: 214832 - DNA, 728 bp, Homo sapiens
  misc_feature: GYAE6OF01CV4DA.1.34.D01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattcgacccagtctccatcctccctgtctgcatctattgganactagacgtcaccatcacgttggccgggngagtcaggccatcagcgtattctttagccttggtgccagcaacgaaaccgngggccacgcccctanagtacttcgtaacgtcgtagtggtgacctaacgtccaagtacgttacggacggtaaacggggttccggggtacccccaagttcccggtaaggtttccgaaggttcgggaccgtaaggtcgtactacgttcggtaagggaacacggttaaccttaccacttcctaacgaacttaacgtccgaacgtaccgaacggttcccacggaccgtaacgtaccgttaagtaaacggtttactttttacgaaacttttaaacgttttacttaacgttacgtaacctaaagttaacgtttaacttaccgtaaacccggttaccccgttaagggtaccgggtttacccggtaccgggtaacgggtaaccgggggtaaacgtaagggttacggaaaccgtaccgtaaaaccggtaacggttggtaccggtagtccgtaaacccg

SEQ ID NO: 214833 - DNA, 614 bp, Homo sapiens
  misc_feature: GYAE6OF01CNXSJ.1.34.D01.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (302)..(302): a, c, t, g, unknown or other
  misc_feature (302)..(302): n is a, c, g, or t
  modified_base (604)..(604): a, c, t, g, unknown or other
  misc_feature (604)..(604): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacgttgccggngagtcaggccatcagcgtattcttagcctggttgcaagcaagaaaccgagggcgacgcccctcagatcgtagtctagtgtnacactccagtattgacgtaacgggtcgggtacccctagtccgtaggttcaggtggacagtgactagtcgtagggaactagtaacttacacgttctactaactatctaacgctagcctgacgacgctaggtaaagtattttacgactttaaatttctttaacgtacgttaacaaacttaagttaactttaacgtaaccgttaccccgttaaggttaccgggtaccgtttaccggaccgggtaacggggtaaccggtaaagggttcggaaaaccgttaaccgaaacccggtaagtgggtaccgngttcgaaccc

SEQ ID NO: 214834 - DNA, 615 bp, Homo sapiens
  misc_feature: GYAE6OF01B9KEM.1.34.D01.1.454.CMB.1.raw
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctagttggagacagagtcaccatccacgttggccgggcgagtcacggccatacagcgtacttcgtttagcccgtggttgcacgacaaggaaaccgcgggacgacgccccgtacagtnttccgtagttctagtggtacgcatcctagacgttgacgagggtcgggtccatcgtacggtctaggtggcagtgactatcgtagggacagtacttaccacttctactacttacacacgtcgacgtcctagccgtagtacccgtaggtaactttcgtttagaacttaacttttaacttaccgtagtacctaattattacttaacgtaccgttaccgttacggtacggtacccggttcgggaacccggtaggggtaaccgtaagggtacggtaacgtacccggaaacggtactgggtacgcgtacgtaccc

SEQ ID NO: 214835 - DNA, 732 bp, Homo sapiens
  misc_feature: GYAE6OF01CVQ7J.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtgggcctcctgctgctctggcctcccaggtaccagctgtgacatccaattcgacccagtctccactcctccctgtctgcatctattggagacagagtcacatcacgttcggccggcgagtcaacggccagtcaagtcgtacttctttacgccgttggttcgacacgacgaaacggaaaaccgcgggaccgacgtccccctacgaagtactccggtagtaccgttagtggtacgactacgtaccagtagttcggtacgaaggggtcggtacccctagtcccgtaaggttactaaggttcggaccgtaagggtcgtaccgtaagttccggtacgggaactaggtaacttaccgaccgttacctacctaactacgttccgaacggtccaacggtccgtagacccgtagtacccgtaagtaaacgtttcgttttaacgacttttaaaacgtttttactaacggtttacgttaacctaacgttaagtttaacgttacttaaccccggttaacccgttagggtaccggttacggttacccgggaaccggtaacggggtaaccggtaaacgggttaacggtaaccgtaaccgtaaaccgtacgttagggtacgtccgtacgtaacccg

SEQ ID NO: 214836 - DNA, 641 bp, Homo sapiens
  misc_feature: GYAE6OF01DD33R.1.34.D01.1.454.CMB.1.raw
  modified_base (101)..(101): a, c, t, g, unknown or other
  misc_feature (101)..(101): n is a, c, g, or t
  modified_base (167)..(167): a, c, t, g, unknown or other
  misc_feature (167)..(167): n is a, c, g, or t
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
tcagacgagtgcgtcacgaccggtgctcgatttagatcgtctgtgttgggtttgggggagtcagaccctgtcaggacacagcatggacatgagggtccccntcagctccgtggggctcctgctgctctggcctcccaggtaccagctgtgacatccaattcgacccngtctccactcctccctgtctgcatctattgganacagagtcaaccatcacttcggccgggcagtcaggccatcgagcgtatttctttacgccttggttgccaagacaacgaaaaccgnggggccgaggccccctacgaagtactcgtaagtctagtcgggtnactataccgagtacttggaccgtaagggtcgggtaccctataccgacggttcaggtggcaggtcgcaacgttcgagggaactaggtaactttaccaccttcctacaactatcagcctacgcctagccagtccctaggtaacgttatttacgacttaaatttacgttactagttaactaactaagttaattacgttaaccggttaaccccgttaggtccggtaaccggtttccgggaaccggtaaggggtaacccgtagggttaaacggtaacgtaaccgtaaccggtaaacgttggtacgcgttcaaacccg

SEQ ID NO: 214837 - DNA, 662 bp, Homo sapiens
  misc_feature: GYAE6OF01D5GMJ.1.34.D01.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtgttggggtttgggggagtcagaccctgtcaggacacagcatggacatgagggtccccgctcagctccgtggggctcctgctgctctggctcccaggtaccagctgtgacatccaattgacccagtctccatcctccctgtctgcatcgtattgganacagatcaccatcacttggccggcgagtcaggccatcagcgtattcttagcctggttgcagacaagaaaccgagggcacggcccctnagatcgtagtctagtggtncatccaagtacgttgacgtaagggtcgggtacccattcccgagttcgaggtggcgtaggtgactagtcggtacgggactaaggtaattacctaccttcctacaacttactacgacggacctacggcccttaggacctacgtaccgtaggtaaacgtttactttttaagactttaaagtttttactaacgtttacgtaacttaaacggttaatttaaacgttacctaaaccgttaaccccgttaggggttaccggtaaacgggtttccggggaaccggtaagggggaaacccggtaagggaaccgggtaaacggtaaccgtaaaaccggtacgtaggtacgggtccgtcggaaaccc

SEQ ID NO: 214838 - DNA, 641 bp, Homo sapiens
  misc_feature: GYAE6OF01B6MZU.1.34.D01.1.454.CMB.1.raw
  modified_base (258)..(258): a, c, t, g, unknown or other
  misc_feature (258)..(258): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctatggagacagagtcaccatcacgttcggccgggcgagtcaggccatcagcgtattcttagcctggttncagcaagaaccgaggcgacgccctcgagatcgtagtctagtggtgcactcagtattcggacgtaaggggtcgggtacccagtccgtacggttcgaggtcggactaggtcgacgtacgtcggtacgggaacaggtacttaccaccttctacctacttaactcgacgcgtacgccgtcgaccacgtccgtaaggtaacgttacttttacgtaactttaattttacgttactacgttaacctaacgttaagtttacttacgttaacccgtacccgttacgggtacggtaccgggttaccggaccgggtaacggggtaacccgttaaaggggtaccgggtaaactaccggtaaaccggtacggttacgggacgtcgtaacgtacccg

SEQ ID NO: 214839 - DNA, 597 bp, Homo sapiens
  misc_feature: GYAE6OF01E4LLG.1.34.D01.1.454.CMB.1.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtccaccatcacgttggccgggcgagtcaggccatcagcgatttctttacgcctggttcgcagcaacgaaaccgngggcacgcccctagagatcgtagtctagtggtncatccagtatcgacgtagggtcgggtccctagtccgtaggttcaggtcggacgtagtgactagtcgtgggaactagtactaccactcctacactanacacgcacgcctgctacgacctagtaagttactttgaactttaagttttacttactcgtaactaacttaaggttacttacgtaaccgttacccgtacggttacgggtaccgttaccggaccggtaaggggaacctaagggttacggtaacgtaacccgtaaccgtacggttacggcggtccgtcgtacccg

SEQ ID NO: 214840 - DNA, 541 bp, Homo sapiens
  misc_feature: GYAE6OF01CEQ6H.1.34.D01.1.454.CMB.1.raw
  modified_base (280)..(280): a, c, t, g, unknown or other
  misc_feature (280)..(280): n is a, c, g, or t
  modified_base (535)..(535): a, c, t, g, unknown or other
  misc_feature (535)..(535): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcagtcaggccatcagcgattcttagcctggtgcagcaagaaccagggcgacgcccctnagatcgtagtctagtggtgcatccagtattcggacgtaaggggtcgggtccccagtcccgaggtttcaaggtggcagtgactagtcgtaggggacaggtacttaacacttcctacacgttatcgagcacgcctgcacggtccttaggaagttattttagactaattttatactgtacaaatagttattatacgtaccctaggtcggacgttcggcgaggggaccaagggtacggaagtaccaaaccgactagcgngtgacc

SEQ ID NO: 214841 - DNA, 857 bp, Homo sapiens
  misc_feature: GYAE6OF01AJEH6.1.34.D01.1.454.CMB.1.raw
  modified_base (102)..(102): a, c, t, g, unknown or other
  misc_feature (102)..(102): n is a, c, g, or t
  modified_base (851)..(851): a, c, t, g, unknown or other
  misc_feature (851)..(851): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctttaaccccggtaacgggttaaccgtacggtaccgttacggttacggtaccgtacgttaccgtaacgtttacggtacccgtacggttaccgttaccgtacgttcccgttacccgttacggttaccgttacggtaccgtacgttaccgttaacggttacggtacgtaccgtacggtacgttaccgtaccgtacgttaccgtacgttcggtaccgggtacgtacggtaccgtacggtaccgtacgtaccgtacggtccgttaattttcccggttaaggcccgttagggttacgaccgtacggtaccgtaacggtaacccggtggggtaccttaaccggtccccgttagtaacgtacgttccggttaacggtcctaaggttccggtactaccgtacttccggtaagtacggtttcggacgtttacgggtccggtacctaggttacccgtaggttacgacggttaccgacgttaacggttccgtacgttacgtccgggttaaggacccgttaagggttaccctttaaccgacggtttaccgtacggtaacttacggtccgtaacggtccgtacgtcccgttagaccgttacgtcgttacgtaacgttcgttacgtaccttggttaactcgtacgttaacgagttcgttacctacgtccggtacgtcggtacgtcgttacggacgtacggtactagttccggaacttcgaacgtcggtagtcgtncgtacg

SEQ ID NO: 214842 - DNA, 777 bp, Homo sapiens
  misc_feature: GYAE6OF01B994Q.1.34.D01.1.454.CMB.1.raw
tcagacgagtgcgtcacgaccggtgctcgatttagatcgtctgtgttgggtttggggagtcagaccctgtcaggacacagcatggacatggacgggtcccccgctcagctccgtggggcctcctgctgctctggctcccaggtaccagctgtgacatccaattcgaccctagtcctccactccctccctgtcctgctattctagttggagaacaggactccacctatccgtacgttcggccgggacgacgtccgaggccaagtcgaagtcgtatttacgttacgccgttgggttcgacgacggacaaacggaaaccggacggggaccgtaccgcccctagacgtaattccgtagtactaggtcggtacactacgtacctaagtagttcggacggtaacggggtccgggtaccctacgtaccgtacggtttacgaaggtgggactaggtacgtacagttcggtagggaactaggtaaccttactaccgttaccacgtaacgttactaccgaacgaccgtaacgcccgtacgaccgtacggtacctaaagttaagttacttttaacggtaactttaaagtttaccttaaccgttaaggttaacctaaacggtttaaacgttaacgtttaaccgtaaccccggttaacccggttaacgggttaccggggtaaaccccgggtttacccgggaaacgggtacccggggtaaacggtaacggggtaaacggtaacccggtaaccggaaccggtaccggttagggtcaccggtaccggtaaccg

SEQ ID NO: 214843 - DNA, 781 bp, Homo sapiens
  misc_feature: GYAE6OF01C37VY.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctcgtggctcccaggtaccagctgtgacatccaattcgacccagtctccactccctccctgtctcgactactctagttggacgaacagacgtaccaaccatacctacgttcggccggggactaggccgacggccagtacgacgacgtactttactttcggccgttggttcgacacggacaaacggaaaccgacgggaccgaaccggtccccctagaacgtacgttaccggtagttaccgtaagttcggtacacgtaaccgttaccgaaggttaacggtttcggaacggttaaacggggttacccgggtacccctaaacggttcccgtaacgggtttaccgtaaggtcggtacgtaggttaccgactacggtaccggtagggacgtaaggttaccttaacgaccttcgtaactaaccgtactacgaacgtaccgtaacgtccgtaccgaactaccggtaccgttaaggtaaagttttacgtttaaccgtaaccttttaaaattttacgttacgtaacgttaaacctaaacgttaagtttaactttaaccgttaacccggttaaccccgttagggtaccgggtaaccgttacccggggacgaaggggtaccgaagggttacgaacggtaccgaacgtacgtatacggtgacgtacccg

SEQ ID NO: 214844 - DNA, 583 bp, Homo sapiens
  misc_feature: GYAE6OF01AJAZ2.1.34.D01.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcacgaaaccgagggcgacgcccctnagatcgtagtctagtggtgcatccagattgacgaaggtcgggtcccagtcccgaggttcaggtcggcaggtcgcgagtcgtagggacagtacttacacgttctacacttatcagcacgcctgccagcctagaagtattttgacttaatttacttacgtcgttactaacgtagttaacttacgtaccgttaacccttacggttcgggtaaccgttccggacccggtaagggggtacccgtaaagggttacgggtaaacgttaccgtaaacccggtacgtaggtcggtccgtacggtaccg

SEQ ID NO: 214845 - DNA, 847 bp, Homo sapiens
  misc_feature: GYAE6OF01CEC4I.1.34.D01.1.454.CMB.1.raw
  modified_base (176)..(176): a, c, t, g, unknown or other
  misc_feature (176)..(176): n is a, c, g, or t
tcagacgagtgcgtcacgaccggtgctcgatttagatcgtctgtgttgggtttgggcatggacatgagggtccccgctcagctcctggggctcctgctgctctggcctcccaggtaccagctgtgacatccaattcgacccagtcctccatccctccctgtctgcatctattgganacagagtcaccatcacgttggccgggcgagtcgaggccatcagcgtactttcttacgccgttggttgcagacaacggaaaccgaggggaccgtaccgcccctagaagtacgtacgttagtcttaagtggtacgctaacgtccgtaagtagttacggacggtaacggggttcggggtacccctagttacccggttaagggttacgtacgggttgggacgtacggtgaccgtagtacggtacggggtactaacggttaactttacctaccttctacctaaccgttataccgacgtaccgacgtccctacggaccgtaacgttaccggtaagtaaacgttttaagttttacgtaaactttaaacgtttttaaccgtttaacgttaaccgtttaaccctaaaaggtttaaggtttttaaacctttaaccggttaaccccggtttaacccgttaacgggggttacccgggttaacccgggggtttacccgggaaacccgggggtaaacgggggtaaacccggttaacgggggttaacgggaaacccgttaaacccgggaaacccgggttaaacgtttggggttaacccggaccggtttaccgaccgttaccccgttaggtttacccttcggtttacccttaccggttaacccctttcccggttaaccccgtaaccc

SEQ ID NO: 214846 - DNA, 820 bp, Homo sapiens
  misc_feature: GYAE6OF01BJ8FJ.1.34.D01.1.454.CMB.1.raw
  modified_base (205)..(205): a, c, t, g, unknown or other
  misc_feature (205)..(205): n is a, c, g, or t
  modified_base (338)..(338): a, c, t, g, unknown or other
  misc_feature (338)..(338): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggcctcccaggtaccagctgtgacatccaagttcggcccagtcctccatccctccctgtctgcatctagttgganacagagtccaccatcacgtggccggcgagcgaggccatcgagcgtatttcgttagccgttggtcgacgagacgaaacggaaaccgaggggccgaccgaccccgtagacgtacgtccggtagtctagtcggtanacctataccgagtagttacggacggtaacggggtcggtaccctacgttcccggtaggttcgaggttccgggacgtaggtacgtactacggttacggtaacggggtaactaacggttaactttaacccacctttcctaactaaccgttactaaccgaacgcctaaccggtcccgttacggaaccctaaccgggtttacccgtaaggtttaaagttttacttttaccggtaaacttttaacgtttttaaccgttaaccgttagtaaaccccgttaaaagtttaactttaaacgttttaacccggttaaccccggtttaacccccggtacggggtttaccgggttaaaccccgggttcccgggaacccgggtaaaccgggggttaacccgggtaaaaggggttacccgggtaaaacccggttaacccgggtaaaacccgggtttaaccggtacggggtacccgggttacccgtcccgaaacccgg

SEQ ID NO: 214847 - DNA, 697 bp, Homo sapiens
  misc_feature: GYAE6OF01CK8KM.1.34.D01.1.454.CMB.1.raw
  modified_base (277)..(277): a, c, t, g, unknown or other
  misc_feature (277)..(277): n is a, c, g, or t
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcaccatcacttggccgggcgagtcaggccatcgagcgtatttcttagccgttggttgacagacaagaaccgngggacgacgcccctgagcgtcgtagtctagtcggtgcactccgagtagttcggaacgtaacggggtcgggtacccacgttaccgtacggttcgagggttcggcgtaaggtcgcgagttcggtacgggaactaggtacttaacgaccttaccgtacaacttatcgaacgcgacgtcctacgacacgtccgtaagtaagttnttttacgactttaagttttaactacgttacgttaacctaaacgttagtttaacgttaccgttaacccggttaccccgttaacgggtaccggggttacccggttaccggggaacccgggtaaccgggggttaaccggtaacggggttaaccgggtaaaccggttaaccccggaaaccggttaaccgggttagggttacccgggacgttaccggtaaacccc

SEQ ID NO: 214848 - DNA, 517 bp, Homo sapiens
  misc_feature: GYAE6OF01AT9KG.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (508)..(508): a, c, t, g, unknown or other
  misc_feature (508)..(508): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctatggtncatccagattgacgaaggtcgggtacccagtccgaggttcaggtcggcaggtcgcagtcgtagggacagtacttacactctacactatcagcagcctgcagtcctagaagtatttgacttaatttatactgtacaactagtattatacgtaccctagtcggtacgttcgggaccgaggggaccaagggtacgaagtacgaaccgatggngtctgtacc

SEQ ID NO: 214849 - DNA, 789 bp, Homo sapiens
  misc_feature: GYAE6OF01BKN7X.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatcccaattcgacccagtctccatccctccctgtctgcatctattggagacagagtcaccatcacgttcgccgggcgacgtcgacggccagtcgacgtacgttactttcgtttacgtccgttggttcgactacgaccgaaacggaaaccgggacggggaccgacccgtacccctacggaacggttaccgtaccggttacggttaccgttaggtcggggtaccaccgtacttacccgtaagttacgttacgggaccggttaacggggttccggtacccctacgttacccgggtacggtttacgaacggggttccgacgtaacggtcgtaccgtacgggttacggtacggggaacctttaacggtaaccctttacccgacccttaccgtaactaaaccgtttacgaccgtacggtaccgtaaccggtccgttacgaaccgtccgttaacgtaagttaagtttacgttactaacgtttaactttacttacgtaacgtaactaagtttacgttacgttaacgtacccgttacggttacggacgggtttacccggtaccgggaccgggtaagggaacccggttaagggaccggttaaccaaccggtaaaccggttaggtacggtcgtaaccgtccgtaacccg

SEQ ID NO: 214850 - DNA, 399 bp, Homo sapiens
  misc_feature: GYAE6OF01ASIX6.1.34.D01.1.454.CMB.1.raw
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (363)..(363): a, c, t, g, unknown or other
  misc_feature (363)..(363): n is a, c, g, or t
  modified_base (386)..(399): a, c, t, g, unknown or other
  misc_feature (386)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcacgcctgaagtattttgctaatttattactgtacaactagtattactacgtacccctagtggacgttcggccgaggggaccaaggtgaagtcaacgactgngctgcacatctntctcatcctcccgcatctagaacgcactcgtcngacgcggctggacaggcacatannnnnnnnnnnnnn

SEQ ID NO: 214851 - DNA, 946 bp, Homo sapiens
  misc_feature: GYAE6OF01EAMHY.1.34.D01.1.454.CMB.1.raw
tcagacgagtgcgtcacgaccggtgctcgatttagatcgtctgtgttggggtttgggggagtcagaccctgtcaggacacagcatggacagtggacgggtccccgctcagctccgtggggctcctgctgctcgtggctcccgaggtaccagctgtgactactacctaattcgacccagtcctccactccctcctgtctgactatctagttagggaacgacgagtacgtaccaacctacgttaccgtacggttcggcccggggacgtacgtaccgacggacctagtccgacgtacgttacttttaccgttacgccgttaggttcgaccgaagaccggaacggaaaaccggacggggtaccgacccgtaccccgtacggaaccggttacgtttaccggttaacggtttcgtaacggttcgggtaacctacccgttaacgtacccggtttaaggttaaccggtttacgggaacggggtttaaccgggggttacccggggtacccccttaaagggttcccggttaaaggggtttccggtaaacggggtcggggtacgttacggtacgggtaccgttaacgttacggggggtaacggttaacgtaacgtttaacccgttttacctaaccttaccggtaacctacgtttaacggccgttaaacgccggttaacccgtccgtacggtaacccgtaacgttcgttaacgtttaaaggtttacgttttaaccgtaacgttttaaattttaccttaccggttaagttaaacctttaacgttaaacgttttaaccgttaccgttaaacccgggttaccccgttacgggttaaccggggtaccccggtaaccgggggtaccgggtaaacccgggtaacgggtaaaccgggttaccggggttaaaacctaacccgggtaaccggtaggtttacgtacccgggaccgttccgtaaaccgg

SEQ ID NO: 214852 - DNA, 719 bp, Homo sapiens
  misc_feature: GYAE6OF01CX2N8.1.34.D01.1.454.CMB.1.raw
  modified_base (99)..(99): a, c, t, g, unknown or other
  misc_feature (99)..(99): n is a, c, g, or t
  modified_base (448)..(448): a, c, t, g, unknown or other
  misc_feature (448)..(448): n is a, c, g, or t
tcagacgagtgcgtcacgaccggtgctcgatttagatcgtctgtgttgggtttggggagtcagaccctgtcaggacacagcatggacatgacggtcccntcagctcgtgggctcctgctgctcgtcggcctccgaggtaccagtctgtacgactatacccaagttcgaaccctagtcctccacttccctccgtgtctgctacttctagtaggactacgagtcgtacactactccgtacgttccggccgggtactacgtcgacggcctaatccgagtcgttaatttcgttacgccgttaggtcgacgtacgtacgaaacggtaacccggtgggacctaccgtcccctaagacgtactcgtacgtcgtagttcggacactacgtcgtagtacgtcgaacggtacggggtccggtacctaggtaccgtaggttcgacgtcggactacggtntacgtggtaccggtagacgtaacgtacgttaccacgtccgtaacacggtactccgaacggtctaacggcttacggactaccgtacgttacgaacgttttgtaaccaagttttacgttaacgttacgtaccgttaaactaacgttaagtttaacccgtacgttaacccgggttacttaccgggtacggtaccggttaccggaccgtagggttaaccctagggttacctaaacggtaccccgttaaggtacgttaggccctacgtaccgtacc

SEQ ID NO: 214853 - DNA, 622 bp, Homo sapiens
  misc_feature: GYAE6OF01EVVBA.1.34.D01.1.454.CMB.1.raw
  modified_base (568)..(568): a, c, t, g, unknown or other
  misc_feature (568)..(568): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(598): a, c, t, g, unknown or other
  misc_feature (596)..(598): n is a, c, g, or t
  modified_base (600)..(606): a, c, t, g, unknown or other
  misc_feature (600)..(606): n is a, c, g, or t
  modified_base (608)..(620): a, c, t, g, unknown or other
  misc_feature (608)..(620): n is a, c, g, or t
  modified_base (622)..(622): a, c, t, g, unknown or other
  misc_feature (622)..(622): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagctagaagtattttgactaattttatactgtacaactagttaattactacgtaacccctaggtacggtacgttccggaccgtaagggggaccaagggttacgggaaacgtacccgtaaaacccggaacgttgggtcggtactacggtacccaaacccgtacgtttaccgttacggttacctttacgaaccttttcccgtttaccccccggaccttaaacgtttcccgttaacggaacccgtccgttaaaccccttcgggttacccgtggggtaaaccgggtcccgggggtaccttaccgggggaacccgaaacggggtcccgaaccgttaaagtacgggtcaaggtccancgacgacgngatacncangngcangntnnnannnnnnngnnnnnnnnnnnnngn

SEQ ID NO: 214854 - DNA, 653 bp, Homo sapiens
  misc_feature: GYAE6OF01BAK6V.1.34.D01.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgctgggcagtcgaggccatcagcgtattctttagccttggttgcagcaacgaaaccgagggccgacgcccctnagatcgtagtctagtggtgcatccagattggacgtaagggtcggggtaccctagtcccgaggtttcgaggtggacgaggtgcgtatcgtgggaactagtacttaacacttctactactatcaacgcacgcctagccgtagtcctaggtaattacgttttagacctttaattttacttacgttacgttaacctaaacgttaagtttaacgttaagttaacccggtttaaacccccgttaggttaccgggttacccgggtttaccgggaacccggggttaaacggggtaaacccggttaaagggtacgggtaaaaaccggttaccggaaacccggtaaacgtttcgggtacgggtaccgtacccggg

SEQ ID NO: 214855 - DNA, 634 bp, Homo sapiens
  misc_feature: GYAE6OF01BFXW1.1.34.D01.1.454.CMB.1.raw
  modified_base (289)..(289): a, c, t, g, unknown or other
  misc_feature (289)..(289): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcgccgggcgagtcaggccatcagcgtattctttagcctggttgcagcaaggaaaccgagggccgacgccccctnagatcgtagtctagtggtgcatccagtacttggacgtaaggggttcgggtaccccagttcccgaggtttcgaggttcggacgtaggtcgctacgtcgtaggggactaagtacttacgacttctactacgtatcgaagcctacgtcctagaccacgtccgtagtaaacgttgttttacgactttaattttaactacgttacgttaactaaacttagttaatttacgtaaccggttaaccccgttaggttcggtaaccggtttccggaccgggtaacgggtaaccggtaaggggtacgtaaacggtacccgtaaacggtacgttggtacggtccgtacggtaacccg

SEQ ID NO: 214856 - DNA, 696 bp, Homo sapiens
  misc_feature: GYAE6OF01BJBFU.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatccctccctgtctgcatctagttggagacagacgtcaccatcacgttcggccgggcgagtcaggccatcgagcgtatttctttagccgtggttgcagacaagaaccgagggcaccgcccctagagtacgtcgtagtcgtagtggtcgactacgtaccgagtacgttggacgtaacggggttcgggtaccccagtccggtaggttcgaggttcggcgtaagtcgacgtagttcggtacgggactaagttaccttaaccgacctttaccgtacctaacttacgtaccgaacggtacctacgtcccgtggacccacggtccttaaggtaactttacgttttagaacttttaaagttttacttacgttacgtaaacctaacgttaagtttaacttaacgttaccccgtaacccgttacggggttaccggtaccgggttccggaaccgggtaacggggtaacccggtaaaggggtaccggaaaccgttaccggaaaccggtagttacggtcggtccgtaacggaccc

SEQ ID NO: 214857 - DNA, 398 bp, Homo sapiens
  misc_feature: GYAE6OF01B2II5.1.34.D01.1.454.CMB.1.raw
  modified_base (388)..(398): a, c, t, g, unknown or other
  misc_feature (388)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtacaacagtattatacgtacccctacgtggacgttcggccaggggaccaaggtggaagtcaaccgactgtgctgcacatctgtctcatcctcccgcatctagaacgcactcgtctgacgcgggtctggacaaggcacagtagnnnnnnnnnnn

SEQ ID NO: 214858 - DNA, 718 bp, Homo sapiens
  misc_feature: GYAE6OF01EFWON.1.34.D01.1.454.CMB.1.raw
  modified_base (105)..(105): a, c, t, g, unknown or other
  misc_feature (105)..(105): n is a, c, g, or t
  modified_base (216)..(216): a, c, t, g, unknown or other
  misc_feature (216)..(216): n is a, c, g, or t
  modified_base (460)..(460): a, c, t, g, unknown or other
  misc_feature (460)..(460): n is a, c, g, or t
  modified_base (513)..(513): a, c, t, g, unknown or other
  misc_feature (513)..(513): n is a, c, g, or t
  modified_base (701)..(701): a, c, t, g, unknown or other
  misc_feature (701)..(701): n is a, c, g, or t
tcagacgagtgcgtcacgaccggtgctcgatttagatcgtctgtggttggggtttgggggagtcagaccctgtcaggacacagcatggacatggacgggtccccntcagctccgtgggctcctgctgctcgtcggcctcccgaggtaccagctgtgactatacctaattcgacccagtcctacctctccctcctgtctagcattctagttcggaanacgaggtactaccactactcctacgttcggaccgggacgtacgacgacggacctacgtacgtacgtaccgttagttttaccgtttacggtccgttgggtcgacgaacgaaccgaaaacggaaaaccggcgggaccgtacccgtccccaagtacgtacgttacgtacgtacttagtcggtactcgtactacgtagtagtcggaacggtacgggtccgacctacgtcgtagtcgaggtcgagtgcncgtactggtaacgactaagtacttaccacttactacgtaacgtatacgtaacncgtacccgacgtacgacccgtagttaacgtaggttaaactttggttaactaacttttaagttcttaacggtactaaacgtacgttaattaaccgttacgttaacccgtaccgggtagttaccgggtaccggtccgggtaacggtaaccgggtaaacgtacggtaacgaacggtaacgtaccgttaagngtaccggactcgtaacc

SEQ ID NO: 214859 - DNA, 717 bp, Homo sapiens
  misc_feature: GYAE6OF01BFRDZ.1.34.D01.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacagtccaattcacccagtctccatccctcctgtctgcatctagtgganacagngtccaccatcacgttggccgggagacgtcaggcctatcgagctattcgttagccgtggttcgacagaccgaacggaaaccggngggaccgaccggccccctaggaacgtacgtccggtaagttcgtaaggtgggtactacgtaacgtaccgagttacgttacgggacgtaacgggggttccggtacccctagtcccggttaggttcgaggtcggactaggtcgccgtagtcggtaggactaagttactaacctaccgtacttacctaacttacgtacacggacgaccgtaccgttacgacccgtacgtaaccgttaggttaagtttacgttttacgaacgttttaaactttattaaccgttactaacgttaaacggttatttaaccgttaccgtaacccggttaccgtacgggttacggtacccgggttaccggaaccgggtacgggtaaaccggtaagggtaaccgtaacgtaaaccgtacccgttaagtcgggtacgtccgacgttaacccgg

SEQ ID NO: 214860 - DNA, 512 bp, Homo sapiens
  misc_feature: GYAE6OF01E3X9N.1.34.D01.1.454.CMB.1.raw
  modified_base (235)..(235): a, c, t, g, unknown or other
  misc_feature (235)..(235): n is a, c, g, or t
  modified_base (494)..(512): a, c, t, g, unknown or other
  misc_feature (494)..(512): n is a, c, g, or t
tcagacgagtgcgtcacgaccggtgctcgatttagatcgtctgtgttgggtttgggagtcaggccatcagcgattctttagcctggttgcagcagaaaccagggcgacgcccctcagatcgtagtctatggtgcatccagattgcgaagggtcgggtcccatccaggttcagtggcagtgcatcgtgggacagtacttacactctcactatcagcagcctgcagcctaggaagtnttttgacttaattttatacgtgtacaactagttattacgtaccgtacccctaggtcggtaccgttccggaccgaagggggtaccaagggtacgggaacgtaccgaaacccggtaagtgggtcggacctcggacctacctagtccttcgtccttacctacgttccccttcccccgccccttccgtaccaccggtcctaccgttaccggtctacgggacgggtccgggtcgtacggggaccgaacgggccgtacagtacgnnnnnnnnnnnnnnnnnnn

SEQ ID NO: 214861 - DNA, 575 bp, Homo sapiens
  misc_feature: GYAE6OF01CJ81L.1.34.D01.1.454.CMB.1.raw
  modified_base (285)..(285): a, c, t, g, unknown or other
  misc_feature (285)..(285): n is a, c, g, or t
  modified_base (366)..(366): a, c, t, g, unknown or other
  misc_feature (366)..(366): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaagaaaccgagggccgacgcccctnagatcgtagtctagtggtgcatccagattgacgaagggtcgggtcccagtcccgtaggttcaggtggactagtgcagtcgngggactagtacttacacttctacaactatcgagactacgcctgcctacgtcctaaggtatattttgactttaatttacttactagtactaatagttaattagtaccgtaccccgttaggtccggtaacggttccggaccggtaacggggtaacctaaggggttacgaaccgttacgaaacccggtaattgggcggtactcggtaacccg

SEQ ID NO: 214862 - DNA, 590 bp, Homo sapiens
  misc_feature: GYAE6OF01ALEO5.1.34.D01.1.454.CMB.1.raw
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattcttagcctggttgcagcaagaaccgagggcacgcccctnagatcgtagtctagtggtncatccagtattgacgtaagggtcgggtcccagtccgaggttcaggtcggacgtagtcgctagtcgtagggactagtacttacgacttctacactanacgtagccgtacgccgtgaccagtcctagtaagttctttacgacttaatttacttacgtagtactaacgttagttaacttacgtaccgtaaccccgttggttacggtaccgttcgggacccgtaagggggtaacctaaggggtacggtaaacgtacccggtaaaccggtaacgttggacggtcgtcgtaacccg

SEQ ID NO: 214863 - DNA, 434 bp, Homo sapiens
  misc_feature: GYAE6OF01DQ3VH.1.34.D01.1.454.CMB.1.raw
  modified_base (207)..(207): a, c, t, g, unknown or other
  misc_feature (207)..(207): n is a, c, g, or t
  modified_base (364)..(365): a, c, t, g, unknown or other
  misc_feature (364)..(365): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
  modified_base (409)..(434): a, c, t, g, unknown or other
  misc_feature (409)..(434): n is a, c, g, or t
tcagacgagtgcgtcacgaccggtgctcgatttagatcgtctgtggttggggtttgggagtcaggccatcagcgattctttagcctggttgcagcacgaaaaccaggggcgagccccctcagatcgtagtctatgggtgcatccagattgcaaggtggggtcccatccaggttcagtggcagtgcatcgtgggacagattacactcncactatcagcagcctgcagcctagaagtatttgactaattttatactagtacaatagtattactacgtaccctaggtaggtaccggtccggaccgaaggggaccaagggtcgaagtcgaaacgactggtcgctgacacatcgtgtctcatctcccgnntcngacncncgtcgtcgtgaggcggctcggacagggtcntatgnnnnnnnnnnnnnnnnnnnnnnnnnn

SEQ ID NO: 214864 - DNA, 752 bp, Homo sapiens
  misc_feature: GYAE6OF01CZQ4P.1.34.D01.1.454.CMB.1.raw
  modified_base (101)..(101): a, c, t, g, unknown or other
  misc_feature (101)..(101): n is a, c, g, or t
  modified_base (472)..(472): a, c, t, g, unknown or other
  misc_feature (472)..(472): n is a, c, g, or t
tcagacgagtgcgtcacgaccggtgctcgatttagatcgtctgtgttgggtttgggggagtcagaccctgtcaggacacagcatggacatgagggtccccntcagctcctggggctcctgctgctctggctcccaggtaccagctgtgacatccaattcgacccagtcctccactccctccctgtctgctattcgtagtggagactaggatccaccattccaccgttggccgggacgacgtccgacggccagtccgaagtcgtactttcgttacgccgttggtacacgagacgaacggaaccgaggggcaccgcccctagacgtatacgtacgtgtagtggtcgactactacagtagttcggacggtaaggggttccggtaacccaggtaccgtaggttcgaaggttcggacgtaaggtcgacgtagttccggaaggtactaagtacttaccacttctactaaccgttaacncgaacgtcgtacggtccccgtaggaccctaacgggtactttaaggttaaccgttttactttaccggtaactttttaaacgtttaaccgtttaacgttaaccgttaacgtaaacgttaagttttaacgtttaaacccggtacccggtttaaacccccgggttgggttaaaccggggttaccggttaaccgggggtacggtaaaccgggggttaaacctaaggggttaacccggtaaagtacccgtaaacggtacgtttcgggacgttccgtagtaccccgg

SEQ ID NO: 214865 - DNA, 543 bp, Homo sapiens
  misc_feature: GYAE6OF01EKLAB.1.34.D01.1.454.CMB.1.raw
  modified_base (197)..(197): a, c, t, g, unknown or other
  misc_feature (197)..(197): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccggcgagtcaggccatcagcgtattctttagcctggttgcagcagaaaccagggcgacgcccctcagatcgtagtctatggtgcatccagtattgacgaagggtcgggtcccagtccgaggttcaggtggcgagtgcagtcgtgggacagattacacttctcactatcgacgcacgcctgcacgcctagaagttntttagactaatttattactgtactaatagttaattactacgttaaccccgtagttcggtaccgttcggaccgtaggggaaccctaagggtcggaaagttacccgaaaccgtaacgtggacggtcgtcgacc

SEQ ID NO: 214866 - DNA, 617 bp, Homo sapiens
  misc_feature: GYAE6OF01D73Y8.1.34.D01.1.454.CMB.1.raw
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcgagcgtattctttagcctggttgcagacaagaaaccgagggccgacgcccctagagtatcggtagtctagtggtgacatccagtattgacgtaaggggtcgggtacccaagtccgtaggttcaggtggctaggtgctagtcgtgggactagtacttacactctacacttancgagcacgcctagcacgtcctagaacttattttagacttaattttacttactacgttaacaaacgttagttaacttacgtaaccgttaaccccgttaggttacgggtaaccggttacccgggaaccgggtaacgggggtaacccgtaaggggtaccggtaaacggtaacccgtaaaacccggtacggttacggtacggtcgtcggtaacccg

SEQ ID NO: 214867 - DNA, 489 bp, Homo sapiens
  misc_feature: GYAE6OF01DN3TA.1.34.D01.1.454.CMB.1.raw
  modified_base (215)..(215): a, c, t, g, unknown or other
  misc_feature (215)..(215): n is a, c, g, or t
  modified_base (454)..(454): a, c, t, g, unknown or other
  misc_feature (454)..(454): n is a, c, g, or t
  modified_base (459)..(489): a, c, t, g, unknown or other
  misc_feature (459)..(489): n is a, c, g, or t
tcagacgagtgcgtcacgaccggtgctcgatttagatcgtctgtgttgggtttgggaggtcaggccatcagcgattctttagcctggttgcagcaagaaaaccaggggcgacgccccctcagattcgtagtctatggtgcatccagattgcaagggtggggtcccatccaggttcagtggcagtgcatcgtgggacaggattacactctcactancgagcagcctgcacgcctagtaagtattttgactaaattttattacgtagtacctaaactagtaactttataacgtaccccgtacgtggaccgttccggccggaaggggacccaagggtcggaagtcgaaaccgtaatggtaggcttgcacctacgtcgtcgtcttcgtactccttaccccgccttccgtcaccgactacctcggtctaggacgtcgggactggacaaggcacctaagngctcnnnnnnnnnnnnnnnnnnnnnnnnnnnnnnn

SEQ ID NO: 214868 - DNA, 586 bp, Homo sapiens
  misc_feature: GYAE6OF01AU59O.1.34.D01.1.454.CMB.1.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatatattgganacagagtcaccatcacttggccgggcgagtcaggccatcagcgtattctttagcctggttgcagcaagaaaccgngggcacgcccctnagatcgtagtctagtggtcgcatccgagtattggacgtaaggggtcgggtacccagtccgtaggttcaggtggcgtaggtcgacgtagtcggtagggactaggtacttacgacttctacactatcagcacgccgtagacacgtccgtagaagttatttacgacttaattttactacgtatacaattagttacttactaccgttacccgtggttacggtaccggttcggaccggtacggggtaaccgtaagggtaccggtaaacgtaccgaaaccggtacgtagggtcgtacgtcgtacccg

SEQ ID NO: 214869 - DNA, 689 bp, Homo sapiens
  misc_feature: GYAE6OF01EW9TA.1.34.D01.1.454.CMB.1.raw
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattcgacccagtcctccatccctccctgtctgcatctattggagacagagtcaccatcacttggccggcgagtcaggccatcagcgtatttctttacgccttggttgacacgacgaacggaaaccgagggaccgaccggccccctagagtacgtccggtagttctagtgggtcactataccgagtagttggacgtaagggtcgggtacccagtccgtaggttcgaggtcggcaggtcgcgtagtcggtagggactacgtaacttacctaccgtctacctaacgtactacgaacgccgacgtcccgtagccgtaagtacccgtaaggttaacgtttagttttacgaactttaaacttttaacgtacgttacgttaacctaaacgttaagtttaacttaacggtacccgttaacccgttacgggtaccggtaaccggttacccggggacccggtaaaggggtaaccgtaaagggtaaccgggtaacgtaacccgtaaaccggttaacggtcggtacggttacccgtgtaacccg

SEQ ID NO: 214870 - DNA, 845 bp, Homo sapiens
  misc_feature: GYAE6OF01BNP9A.1.34.D01.1.454.CMB.1.raw
tcagacgagtgcgtcacgaccggtgctcgatttagatcgtctgtggttgggtttgggggagtcagaccctgtcaggacacagcatggacatgagggtccccgctcagctccgtggggctcctgctgctctggcctcccaggtaccagctgtgacataccaattcgacccagtcctccactccctccctgtctgcatctagtggagacagatccacctataccgtacgttcggccgggacgtacggtcgacggtcctaatcgacggtacgttactttaccgtttaggtcccgttgggtttacgaccgaacggaccgaaacggaaaaccccggaggggacccgacccggaccccctagtaacggtaacgttccggttaaacgttcttaaggttggtacactacgtacctaaggtacttcggacggtaacgggggtccggtaacctagtacccggtaggttcgaaggtcggactaggtcgacgtacgttacggaggaactacgttaacgtcctacttcaacgtactttacgaccacggtaccgaaccggtcacggtaacctcggttaaccgaagtttaacgttagtttttacgaactttttaaacgtttaccgtttaacgaccggttaaacgttaaaccgtttaacgtttaaccggttttaaacccgttaaacccccggtttaaccccgggttttacgggtaaaccggttaccccgggggtttaccgggaacccgggtttaacccggggggaaccggtttaaaacggggttacccgtaaaacccgggtttaacccgttaaacccgggtacgggttttaaggggccccgcgggttttaaccgaccccgg

SEQ ID NO: 214871 - DNA, 549 bp, Homo sapiens
  misc_feature: GYAE6OF01A0IJL.1.34.D01.1.454.CMB.1.raw
  modified_base (516)..(516): a, c, t, g, unknown or other
  misc_feature (516)..(516): n is a, c, g, or t
  modified_base (544)..(549): a, c, t, g, unknown or other
  misc_feature (544)..(549): n is a, c, g, or t
tcagacgagtgcgtcacgaccggtgctcgatttagatcgtctgtgttgggtttgggggaggcttgataaagcctggggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccggttcaccatctcccgagacaattcgcagaacacgttgtttttgcaaaatggacagcctgagagtcgcggacacggccgtctattattgtgcgacgcgctattataatataggctacgtgggccagggaaccctggtcaccgtctctcacgcctccaccaagggcccatcccgtccttccccctggcctccctgcctccgaggacgccaccctcccgagacgcaccgagccgggcccctgggcctgcccgtggacaagggaccttacttccgacgcacgtcgtcnggacgcgggctggacaggccgacatagnnnnnn

SEQ ID NO: 214872 - DNA, 699 bp, Homo sapiens
  misc_feature: GYAE6OF01A8W42.1.34.D01.1.454.CMB.1.raw
  modified_base (211)..(211): a, c, t, g, unknown or other
  misc_feature (211)..(211): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatcctccctgtctcgcatctagtggagacagagtcaccntctacgttcgccgggcgagtcgacggccatcagcgtattcgtttagccttggttgcagacaacgaaaccgaggcgacgcccctagagatcgtacgtctagtggtcgactactccgagtagtggacgtaacggggtcggtaccccaagtccgtaggttcaggtcgcgagttcgctagtcgagggactagtactactacctcgtacctaactactaccgacgtaccgacgtcccgtagaccgtaccgaccggttaaggttaaagtttacgttttacgtaacgtttaaactttttaacgtttaaccgttaacggttaaccttaaacgttaacgtttaacgtttacgttaacccggttaccccggtacggtttaccgggttaacccggttaccgggaacccgggtaggggtaacccgggtaaacgggtaacgggttaaacccgtaaaccggtaaacccggtaacgtacgggttaccgtcgttacggtaaccc

SEQ ID NO: 214873 - DNA, 677 bp, Homo sapiens
  misc_feature: GYAE6OF01BWBMM.1.34.D01.1.454.CMB.1.raw
  modified_base (254)..(254): a, c, t, g, unknown or other
  misc_feature (254)..(254): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (393)..(393): a, c, t, g, unknown or other
  misc_feature (393)..(393): n is a, c, g, or t
  modified_base (453)..(453): a, c, t, g, unknown or other
  misc_feature (453)..(453): n is a, c, g, or t
tcagacgagtgcgtcacgaccggtgctcgatttagatcgtctgtgttgggtttgggggagtcagaccctgtcaggacacagcatggacatgagggtccccactcagctcgtggggctcctgctgctctggctcccaggtaccagctgtgacatccaattgacccagtctccatcctccctgtctgcatctagtggagacagactcacatacaagtcgcgggcagcaggcctatcagcgtattcttagctggttnacgagacgaacgaaaccgagggacgtaccggacccctanagtatccgtagttaccgtagtggtnaccaatccgaggtattacggaggtaaacggggttcgggtaaccctacgtaccgtaaggtttacggaggtacgganaacggttgaccttagtaccggttagggaacctagtactaactacctacgtactaacttancgaacgtacacggtacctacggacgtacccgttagtacggtaaagtttacgttttacggtaactttaagttttaacttacgttaggtaaactaaacgttaagttaacgttaacgtaacccggttaacccgttaggtaccgggtacgttaccggccggtaacggggtaacgtaaacgggtacgaaaccggtaccgtaaaccgtacgtaggcggtagtccggtaac

SEQ ID NO: 214874 - DNA, 673 bp, Homo sapiens
  misc_feature: GYAE6OF01EYL84.1.34.D01.1.454.CMB.1.raw
  modified_base (347)..(347): a, c, t, g, unknown or other
  misc_feature (347)..(347): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccaggtaccagctgtgacatccaattcgacccagtctccactccctccctgtctgctatctagtggagacagagtaccaccatctacgttcggccgggcgagtcgacggccatcgagtcgtatttcgtttacggccgttggttcgacaggacgaaacggaaaccgacggggccgaccgtcccctagacgtacgttcggtagtctagtggtcncactcgagtacgtgacggaacgggtcggtaccctagtccgtaggttcgaggttcggacgtgtcgtacgtagtcgtagggaactagtactactacctacacgtaactagtcgacgtcgacgtccgtagacctagccgttaagtaacgtttactttacgaactttaaattttactacgttacgtaacttaagttaacgtttaacttaacgtaacccgttacccggttacgtacgggtaccgggttacggacccgggtaaaggggtacccggtaaagggtacgtaaacgaaccggtaaacccggttagtacgggtcgtactccggtaac

SEQ ID NO: 214875 - DNA, 880 bp, Homo sapiens
  misc_feature: GYAE6OF01DSHA3.1.34.D01.1.454.CMB.1.raw
  modified_base (269)..(269): a, c, t, g, unknown or other
  misc_feature (269)..(269): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtcctccatcctcctgtctgcatctattggagacagagtcaccatcacgttcggccgggcgagtcaggccatcagcgtattctttagccgttggttcgacagacaacgaaaccgagggcgacgcccctnagatcgtagtctagtcggtgcactccagtagtgacgaagggtcgggtcctagtaccgtaggttcaggtcggcgtacggtgaccgtagttcggacggggtaactaacggttaactttaaccgtacctttaccgttaacctaaccgttaaacttaccggaacgtaccgtaaccggtccccgttacgggaccgtaacgggttaccccggttaaaggtaaacggtttttaacgtttttaaccgggtaaccgtttttaaactttttttaaaccgtttaaccgttttaaccgggtttaaaccttaaaacggtttaacgttttaaaacgttttaaacccggtttaaacccggtttaacccccccgggtttaacgggtttaaccgggggtttaaccccgggtttaacccggggggtaacccggggtaaaccggggggttaaccccgggttaaagggggttaaccggtaaaaccggggtttaacccgtaaaaaccccgggttaacgggttacgggtaccgggtaaccggttacggtacccgttaaacccgttacgtttacccggtttcgttttaacccgttaccgttaaccccgtttcccgttaaccccccgttaacccg

SEQ ID NO: 214876 - DNA, 719 bp, Homo sapiens
  misc_feature: GYAE6OF01BBRRW.1.34.D01.1.454.CMB.1.raw
  modified_base (221)..(221): a, c, t, g, unknown or other
  misc_feature (221)..(221): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggngagtcaggccatcagcgtattcttacgcctggttgcagcaagaaccnggcacgcccctnagactcgagtctagtggtgactatccgagtgttacggaccggtaaaggggtccggggttacccacgttcccgaacgggtttcgtaacggtcgggactaagggttcgacctacgtcgtacggggacaagggtactttaaccgaacccgttccttaacctaacttacgttaccgaaggaccctaacggtcccttacggaccgtaacggtcccttaaggtaacgttaagtttttaaccggtaacttttaaactttttaacgttaaccttaagttaacccgaaactttaacgtttaactttaacgtaacccgtttaacccccgtagggttaccgggtaacccgtttacccgggaaccggggtaaccggggttaaccgtaacggggttacgggtaaaacttacccgaaaaccggtacgtaggttacgggcccttacgggtaccc

SEQ ID NO: 214877 - DNA, 512 bp, Homo sapiens
  misc_feature: GYAE6OF01D9H4B.1.34.D01.1.454.CMB.1.raw
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
  modified_base (506)..(506): a, c, t, g, unknown or other
  misc_feature (506)..(506): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatcagattgcaagggtgggtccatcccaggttcagtcggcagtgcatcgtgggacagtattacactctcatntacagcagcctgcagcctagaagtattttgataatttatactgttacaactagttaattactacgtaccctagtcggtaacgttcggaccgagggtaaccgaaggtacggaagtaccgaaccgtaacgtgtcgngtgacc

SEQ ID NO: 214878 - DNA, 581 bp, Homo sapiens
  misc_feature: GYAE6OF01DV2E8.1.34.D01.1.454.CMB.1.raw
  modified_base (101)..(101): a, c, t, g, unknown or other
  misc_feature (101)..(101): n is a, c, g, or t
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (320)..(320): a, c, t, g, unknown or other
  misc_feature (320)..(320): n is a, c, g, or t
  modified_base (491)..(491): a, c, t, g, unknown or other
  misc_feature (491)..(491): n is a, c, g, or t
tcagacgagtgcgtcacgaccggtgctcgatttagatcgtctgtgttgggtttgggggagtcagaccctgtcaggacacagcatggacatgagggtccccntcagctccgtgggctcctgctgctctggctcccaggtaccagctgtgacatccaattcgacccagtctccatccctcctgtctgcatctagtgganacagatcaccatcacttcggccgggngagtcaggccatcagcgtactttcttacgcctggttcacagacaacgaaaccgaggcgacgcccctgagtactcgtagtctagtgtgactatcagtntcgacgaacgggtcggtaccagtaccgaggttacaggtcgctagtcgactagtcgtgggaactagtacttaccgacttctaacgtacttaatcgacgctacgcctgcacgtccgtaagtaacgttctttacgaactttaattacttacgtataacctaagtattaacttanaaccggttaccctagggtccgtaaccggttcggacgtaaggggtaactaagggacggtaaactacgtaaccgttagaggtcgctgtaccc

SEQ ID NO: 214879 - DNA, 552 bp, Homo sapiens
  misc_feature: GYAE6OF01BWT2W.1.34.D01.1.454.CMB.1.raw
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggccgacgcccctnagatcgtagtctatggtgcatccagtatgcaaggtggtcccatcgaggttcaggtgcagtgctatcgnggacagtattacactctactactatcagcacgctgcagcctagtaacgtattttacgattaacttttataccgtagttactaaacgtagttattaacgtacgttaaccccgttacggtacggtaccggttccggtaccggtaaggggaaccgtaagggtacggaacgtaccgtaaccgtaacgtaggtcgtcgtcgtaccg

SEQ ID NO: 214880 - DNA, 618 bp, Homo sapiens
  misc_feature: GYAE6OF01EQUF4.1.34.D01.1.454.CMB.1.raw
  modified_base (398)..(398): a, c, t, g, unknown or other
  misc_feature (398)..(398): n is a, c, g, or t
  modified_base (578)..(578): a, c, t, g, unknown or other
  misc_feature (578)..(578): n is a, c, g, or t
  modified_base (600)..(600): a, c, t, g, unknown or other
  misc_feature (600)..(600): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcagaaaccgagggcgacgcccctacagatcgtagtctagtggtgcatccagattcgcgaagggtcggggtccatccgagttcagtggcagtgcatcgtgggacagtattacacttcctacactatcgagaccagcccgttagcctacgacctagtaaacttnttttcgaacgtttaattttaacttacgtgtactaaagtagtttaattacgttaacccggtaccccttaagggttcggtaaccggtttccgggacccgtaaacgggggacccgtaaggggtaccggtaaagttacccgaaaaccggtacgtcggggtagtcccgacgtaccctaacccgtntttaccgttgtaccgtttaacncgtttccccgccccgtac

SEQ ID NO: 214881 - DNA, 503 bp, Homo sapiens
  misc_feature: GYAE6OF01BQUIV.1.34.D01.1.454.CMB.1.raw
  modified_base (257)..(257): a, c, t, g, unknown or other
  misc_feature (257)..(257): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattggacgtaagggttcggggtaccccagtcccgtaggttcaggtggcagtgcatcgtgggacagtattacactctcaactatcagcagcctgcagtcctagaaagttatttagacttaatttattactgtactaatagttattactacgtaccctgtcgtacgtcggacgagggacaggtagatacacgatgngctgcacntctgtctncttcctccgac

SEQ ID NO: 214882 - DNA, 794 bp, Homo sapiens
  misc_feature: GYAE6OF01DID6N.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctccgtggggctcctgctgctctggctcccgaggtaccagctgtgacatccaattcgacccagtctccatcctccctgtctgcatctagtggagactagacgtcaccatccacgttcggccgggacgagtcgacggccatcgacgcgtactttacgtttacggccgttggttcgacgagacgaacggaaaccggagggaccgaccgcccctacaagtacgttacgtacgtctagtggtacgactacgtaccgagtacgttaggacggtaacggggttccgggtaccctacgttaccggtaggttcgaaggttcgggaccgtaaggttcgaccgtacggttaccggtacggggaactacgttaacttaacccacgttaccctacctaacttacgtaccgtaacggcccgacggtcccttaggaccgtaaccgggtaccttaaggtttaaacgtttacgtttttagtaacttttaaacgtttttagttaccgttacgttaacttaaacgttacgttttaacttaaccgttaacccgggtttaaccccgttaacggggttacccgggttaaccggggttacccgggtaacccgggaaacgggggtaacccggtaaacgggggttacgggtaaaaccgtacccggtaaaacccgggttacggtaccgggttacggccgttacggtaccccg

SEQ ID NO: 214883 - DNA, 773 bp, Homo sapiens
  misc_feature: GYAE6OF01AGK71.1.34.D01.1.454.CMB.1.raw
  modified_base (102)..(102): a, c, t, g, unknown or other
  misc_feature (102)..(102): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
tcagacgagtgcgtcacgaccggtgctcgatttagatcgtctgtggttggggtttggggagtcagaccctgtcaggacacagcatggacatgagggtccccnctcagctcctgggctcctgctgctctggctcccaggtaccagctgtgacactccattgacccagtctccatccctcctgtctgcattctagttgganacagacgtcaactntccacttcggaccgggcgtacgtccgaggccctatcgacgtcgtaagtttcgtttacggccttgggttgaccgacgcgaacggaaaccgtggggaccgaccgccccttcgagtacttcggtatcgtagtcggtctacgactccgtagtacgttcggaacgtaacgggtccgggtacccaacggttacccgtaacgggttctaaacgggttccgggtagttaacgggtacgtccgtaaacggttccccgggtaggggaacccttaacgggtaacctttaacccgacccgttttacgttaacctaaccgttttaccgccgtaaccgcccgtaaccgttcccgttggaaccctacggtacccgtaacggttaaacgttttactttaagggaacttttaacgtttaacggttactacggtttaacaacgtttatttaacgttacccgttaacggttacccgtaaggtcgggttaaccgttccggaaccggacccggggttaaacaacgggttaggtaacctaccccggtaaacgttaccggaggttccggaaaccgtcgaaccg

SEQ ID NO: 214884 - DNA, 756 bp, Homo sapiens
  misc_feature: GYAE6OF01B3UTT.1.34.D01.1.454.CMB.1.raw
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtgacatccaattcgacccngtctccatcctcctgtctgcatctagttgganacagagtcacctatcacttggcccgggacgtacgtcacggccagtccagcgtatttcgttacgccgttggttcgcagacaacggaaaccgacgggaccacgtcccctacgagtacgttacggtacgttcgttaagtcgggtacacctaacgtaccgaaggtactttacgggaccggtaacggggggttcccgggtacccctaacgtttccccgggtaaggttttcgagggttcgggacgtacgggtcgtacgtacggttacggtacggggaaactacgttaacttacgtaccttcctactaacttacacgacgtacgaccgtccgtagccgtacgtaccgtaagtaacgtttactttcgtaactttaattttacgttaaccgttgttaaccttaacggttaactttaagtttaccgtaacccggttaaccccgttagggttaccgggaacccggttaccgggaacccgggtacggggaaaccgggttaacgggaaccgggttaaaccgtacccgtaaaacccgggtagttaccggtacgggtaccgtcggtaaaccccg

SEQ ID NO: 214885 - DNA, 721 bp, Homo sapiens
  misc_feature: GYAE6OF01A0520.1.34.D01.1.454.CMB.1.raw
  modified_base (102)..(102): a, c, t, g, unknown or other
  misc_feature (102)..(102): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatccctcctgtctgcatctagttggagacagagtcaccatcacgttggccggngagtcaggccatcgagcgtattcttagccgtggtncagcaagaaccgnggcgacgccctnagagtcgtagtctagtggtnctatcctagtattggacgtaaggggtcgggtaccctagtccgtaggttacgaggttcggacgtaggtcgactacgtcggtacgggaactacgtaacttaccgaccttaccgtaactaacgttaactaccgaacggtacccgtaacggtcccgtacgaccgtacgtacccgttaaggtaaacgttttacgtttaaccggtaactttaaatttttaccgttaacgttaccgttaaacctaaacgtttaacgtttaacttaacgttaacccggtttaaccccggtttagggtaccggggtaacccggtttaccgggaacccgggttaaaggggtaaccccgtaaaaggggttaccgggtaaaacgttaacccggtaaaaccggttacggttacgggtccggtaccgttacggtaaccccg

SEQ ID NO: 214886 - DNA, 781 bp, Homo sapiens
  misc_feature: GYAE6OF01ANXCB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtagactactacctaagttccgaccctagtcctcctacttcccctcccgttgtcgtcgactacttacgttaggttaggaagtagttaacggtacgttcccaacctactaccgtaccgttccgggacccgggacgtacgtccggacggtaccaacgtacgacgtacgttacgttttaccgtttacgtccgttggtcgacgaacgtacgaacggaaaccggcgggaccgaccgtcccctagacgtacgttacgtagtcgtaggtcggtacgactacgtaccgtagttacgttcggaacgttacgggggtcccggtacctaacgtaccgtaggttcgaggtcgacgtaggtacacgtagtacggtacggactaacgtacttaccgacttccgtacgtactacgacgtacgacgtaccgcgtcgaaccgtacgtccgttaaggttaacgttcgttttaactacgtttaaacgtttacgtacgttacgtaacgttaagttaacgttaacgttaaccgtacccgttaacccgttgggttaacccgggttacgttacccgggaccggaacggggttaaccgtaggggtaaccgtacgttaacccggaacggtttacggtcggtaaccgtcgtcccggtaacc

SEQ ID NO: 214887 - DNA, 807 bp, Homo sapiens
  misc_feature: GYAE6OF01C11TC.1.34.D01.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccgaggtaccagctgtgacactccaattcgacccagtctccactcctccctgtctagcatctatggaganagagtcaactntccgacgttcggccgggacgtagtccgacggacctactcgaacgtccgtacgttttaccgtttacgcccgttaggtttcgacgaacgaccgaaacgaaaaccggagggaccggtacccgaccccgtaccgaagaccgttaccggttagtaccgttagtcgggtagacctacgtaccgtagtacgttacggacggtaacggggttccgggtaccctacgtaccggtacggtttacgacggttacgggcgtaacgtcggacgaacggtttcggtaacgggactaacggtaactttaccgaccttccgttaactaccgttaacgtacgaacggtctacggccctacggtccgaacgtaccgtaacgttaaacgttttatttaacgtaccgttttaaagtttacttaccgttagtaaccgttaatacgttttaacgttaaccgttaccgttaaacccccgtttgggttaaaccggggtaccggttaaccccgggtaacggggtaaccgggttaaaccggtaaagggttaccggggttaaacgtaacccggttaaacccggtaacggttttgggaaccggtccgtacggttaaccccg

SEQ ID NO: 214888 - DNA, 614 bp, Homo sapiens
  misc_feature: GYAE6OF01DVTFY.1.34.D01.1.454.CMB.1.raw
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattgganacagagtcaccatcacttggccgggcgagtcaggccatcagcgtatttcttagccttggttgcagacaacgaaaccgagggccgacgcccctgagtactcgtagtctagtggtcgctatccagtattgacggtaagggtcgggtacccagtccgtaggttcaggtggctagtcgctagtcgtagggaactagtacttaccacttctacacttatcacgcacgcctagaccacgtcctaagtaacgtttattttacgaactttaaattttacttacgtagttaacctaaagttacgtttaacttaacgtacccggttaaccccgttagggttaccggtaccggttccggaaccggtaagggaacccgtaagggtacggtaacgtaacccgaaaccgtagttggacgtcgtcgtaccc

SEQ ID NO: 214889 - DNA, 735 bp, Homo sapiens
  misc_feature: GYAE6OF01CSS2L.1.34.D01.1.454.CMB.1.raw
  modified_base (207)..(207): a, c, t, g, unknown or other
  misc_feature (207)..(207): n is a, c, g, or t
  modified_base (587)..(587): a, c, t, g, unknown or other
  misc_feature (587)..(587): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctcgtggctcccaggtaccagctgtgactataccaattcgacccagtcctccactccctcctgtctgcattctagtgganacagacgtacaccatcgtacgtcggaccgggcgacgtcgacggccatcgacgtcgtactttacgttacggccgttaggttgacctaacggaccgaaacggaaaacccggcggggaccgtaacccggtcccccgtaagaacgtacgttacggtacgttacgtaagttcgggtacaccgtacgtaccgaaggtacgttacggacggttaacggggtccggtaccctaaggttacccgtaggttcgaacggtcggacgtacggttcacgttacggtacggtaacgggtaactaacgtaaccttaaccgtactccgtaacctaactacgttacgaacggtacctccggtaccgtacggacgtaccgtacgtaagttaacgtttntaacgtactttaattcgtactacgaactaagtaatttacgtacgtacccggtacgttacggtacgggtacccggttacgggaaccgggaacgggtaactaagggaccgtaaacaaccgggttaacaggttacggacgtcgtcgaaccg

SEQ ID NO: 214890 - DNA, 884 bp, Homo sapiens
  misc_feature: GYAE6OF01EUEFP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactccctcctgtctgcatctagtggagacagacgtccaccatcacgttcggccgggcgagtcgacggccatcgagtcgtatttcgtttagcccgtggttcgcgacgaccgaaacggaaacccggaggggaccgaccgtcccccgtacgaacggtacgttaccggtagttaccgtaggttgggtacgaccgtacgtaccgtaagttacgtttacgggaccggtaacgggggttccgggtacccctaacggttacccggttacgggttaccgtaacgggttaccgggtacgtacgggttaccggaccgttaacggttaccgggtaacggggtaacctaacgggttaaccttaacccgtacccgtttacctaacccgttaaccgtttaaccgtaccgtaacggtaccccgtaccgggtaccccgttacgggaacccgttaaccggttaccgtttaaagggttaacgttttaccggtttttacgaaacgtttttaacttttaaccgttacccgttagttaaacctaaacggtttaacgttttaaccgtttaacccgttaaccccggttaacccggttaacgggttacccgggtaacccggtttaacccggggaacccgggttaaacggggggttaacccgtaaagggggttaaccggtaaaccgtaaaccccgtaaacgggtacgttacgggtaccggtacgtaccgtaaccccg

SEQ ID NO: 214891 - DNA, 704 bp, Homo sapiens
  misc_feature: GYAE6OF01CV9PG.1.34.D01.1.454.CMB.1.raw
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatcctccctgtctgcatctattggagacagagtcaccatcacgttcggccgggcgagtccgacggccagtcgagtcgttatttccgtttacgccgttggttcgccgaacgcgaaacggaaaccggngggaccgacgtcccctagagacgttcggtatcgtagtcggcactacgtaccgagtagttcgacggtaacgggttcggtaccctagtccgtaggtcacggtcggactagtcgctacgtcggagggactagtaacttaccgacttctacctatacgtacgacgtccgacgtcccgtagaccgtacgtccgttaaggttaacgtttactttttacgtaaccttttaaagtttttaacttaccgttaccgttaactaaacgttagtttaaactttacccggtaacccggtttaaccccgttagggttaccggtacccgggttaccgggtaaaccgggtacggggtaaaccggtaacgggtaacggtaaccgtaccgtaaaccggtagtggtacgccgtagtaaccccg

SEQ ID NO: 214892 - DNA, 697 bp, Homo sapiens
  misc_feature: GYAE6OF01ARVBW.1.34.D01.1.454.CMB.1.raw
  modified_base (332)..(332): a, c, t, g, unknown or other
  misc_feature (332)..(332): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtgacatccaattcgacccagtctcaatccctccctgtctgcattctattggagacagagtaccaccatctaccgttcggccgggacgacgtcgacggccatcgagtcgtaatttcgtttacggccttggttgacagaccaaggaaccgagggccacgcccctgagtactacgtagtctagtggtcncactccagtattggacgtaagggtcggtacctagtccggtacggttgacgggtcgaactaggtcgacgtagttaccggagggactaacgtaacttaccgaccttcaccgtaacgttactacgacgtactaccgtcctgaccgtacgtaccgtaggttaaacgttagttttacaacggttttaatttaacgtacgttacgtaaacctaagtttaacgttaatttaaccgtacccgggtttaaaccccgttacgggttaccgggttaacgggtttacccgggaacgggtaacgggggaaccgttaaaggggtaaccggtaaccgtaacccgtaaaccggtacggtggtacggtccgtcggtaacccg

SEQ ID NO: 214893 - DNA, 779 bp, Homo sapiens
  misc_feature: GYAE6OF01AJKJL.1.34.D01.1.454.CMB.1.raw
  modified_base (102)..(102): a, c, t, g, unknown or other
  misc_feature (102)..(102): n is a, c, g, or t
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggcctccaggtaccagctgtgactatccaattgacccctagtctccatcctccctgtctgcatctattggagacagagtcaccatcacttggccgggnagtcaggtccatcagcgtacttctttacgccgttggttgcgtagacgaacggaaaccgnggggaccgtacgcccccgttnacgtacgtaccgtagtctagtggttgaccatcccaagtacgttacggcgtacggggttcgggtaccctagttcccgtagggtttccaagggttcggacgtaggtcgcgtaacgttccggtacgggaactagtaccttacgacccttcgtacctaacgttactacgacggtccgtagtaccccgttagccccgtacggtaccgttaacggtacggtttaacttttttaacggaactttttaaccgtttttaacgttaccgttacggttaaccctaaacgttacgttttaacctttacgttaaccccggtttaaaccccgttacgggttaaaccgggttaaccccgggttacccggggtaaccggggtaaacccgggggttaaacccggtaacgggggttaaaccgggtaaaccggttacccggtaaaacccgggttaccgttagggtttacccgggccgttaaggtaacccccg

SEQ ID NO: 214894 - DNA, 524 bp, Homo sapiens
  misc_feature: GYAE6OF01AEQAE.1.34.D01.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (517)..(517): a, c, t, g, unknown or other
  misc_feature (517)..(517): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggttgcagcagaaaccngggcgacgcccctnagatcgtagtctagtggtgcatccagtattggacgtaaggggtcgggtcccagtccgtaggttcaggtggcgagtgcagtcgtagggacagtattacacttctactactatcagcagcctgcacgcctagacgttatttgacttaatttactactgtacactagttattactaccgtacctgtcggtacgttacggcgacgggacgaggtacgtaagaccgaacgacgtgcgngtgtacc

SEQ ID NO: 214895 - DNA, 681 bp, Homo sapiens
  misc_feature: GYAE6OF01C8BQY.1.34.D01.1.454.CMB.1.raw
  modified_base (198)..(198): a, c, t, g, unknown or other
  misc_feature (198)..(198): n is a, c, g, or t
  modified_base (473)..(473): a, c, t, g, unknown or other
  misc_feature (473)..(473): n is a, c, g, or t
  modified_base (502)..(502): a, c, t, g, unknown or other
  misc_feature (502)..(502): n is a, c, g, or t
tcagacgagtgcgtcacgaccggtgctcgatttagatcgtctgtgttgggtttgggggagtcgagaccctgtcaggacacagcatggacatgaggtccccgctcagctcctgggctcctgctgctctggctcccaggtaccagctgtgacatccaattcgacccagtctccatcctccctgtctgcatctattcgganacagagtccacctatccacgttcggcccgggcgagttccaaggcctatccagcgtatttactttacgccgttggttcgccgagccaacggtaaacccgagggccgtacgcccccgttacacggtacttacggtaacgtccgtaggttcggtcgacgtaacgttcccaaggtacgtttcggacggtaaacggggttcgggggtaccccctaaggttcccgtaggtttaccgaggttcggacctagtcgactacgtcgtagggactagtacttaacnctctacacttatacagtcagtcctagacncgtacctaggtaacgttgttttacgaacgtttaactttaacgttaccgtacgtactaaacgttagtttaacttacgttaaccgttaaccccgttagggtacggttaccgttaccgggccgtaacggggtacctaagggtcgtaaacgttccgtaaaccgtatcggtacgtctgtacccg

SEQ ID NO: 214896 - DNA, 520 bp, Homo sapiens
  misc_feature: GYAE6OF01ER4FH.1.34.D01.1.454.CMB.1.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (489)..(489): a, c, t, g, unknown or other
  misc_feature (489)..(489): n is a, c, g, or t
  modified_base (505)..(505): a, c, t, g, unknown or other
  misc_feature (505)..(505): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgatttctttagcctggttgcagacaagaaaccgagggcgacgcccctnagatcgtagtctagtggtncatccagattgacgagggtcgggtaccagtcctaggttcagtggcagtgctatcgtagggacagtacttacactctacactatcagcagcctagcacgcctagtaagttatttagacttaatttatactagtacaactagttacttacgacttacccgtaggtcggtacgttcgacggtagggactaggtgaacgtacacgtagtgtcgntgcactatctctctanactcctcccctaccc

SEQ ID NO: 214897 - DNA, 588 bp, Homo sapiens
  misc_feature: GYAE6OF01A6CPM.1.34.D01.1.454.CMB.1.raw
  modified_base (265)..(265): a, c, t, g, unknown or other
  misc_feature (265)..(265): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (580)..(580): a, c, t, g, unknown or other
  misc_feature (580)..(580): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctcgtggctcccaggtaccagctgtgacatccaattcgacccagtcctccactccctccctgtctgctatctagttggagacagagtcaccatcacgttcgccgggcgagtcaggccatcagcgtattcttagccgtggtncagcaagaaccgagggcgacgccccngagtatcgtagtctagtggtnctatccgagtagttggacgtaacggggtcgggtaccccagtccgtaggttcaggtcggacgagtcgactacgtcgtagggactagtacttaccactctacgacttagcagcctagcctaggccacgtacgtagtaagttatttagactttaatttacttacgagttaccaagttattaacttacgttacccgttacccgttaggtccggtaccgttacggacggtagggacgtaaggtacgaaccgtacgtaaacgtacgtaggtcgngtcgaacc

SEQ ID NO: 214898 - DNA, 701 bp, Homo sapiens
  misc_feature: GYAE6OF01B0I54.1.34.D01.1.454.CMB.1.raw
  modified_base (130)..(130): a, c, t, g, unknown or other
  misc_feature (130)..(130): n is a, c, g, or t
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctntggctcccgaggtaccagctgtgacatccaattcgacccagtctccatccctcctgtctgcatctagtgganacagactacaccatcgacgttcggccgggnagtcacggccatcgagcgtattcttagcgttggtcncagacaaggaaccgagggcgaccgtcccctanacgtactcgtagtactagtggtcacacgtaccgaagtacgttacggaccggtaacgggggtccggtacccctaagtacccggtaaggttccgaggtcggactaggtcgacgtaggttaccggagggaataacgtacttaaccacttcctaactactactaccgaagccgacgtcccgagaaccgtacggtacctaaggtaacgttagttttacccgaattttaaactttacttaccgtacgttaaacttaaacgttaggttaaacttaccgtaacccgttacccgttagggtaccggttaaccggttcccgggaacgggtaacggggtaaaccgttaaggggtaaccggtaaaccgtaacccggtaaacgttaacggttgacgggtcctaacgggtaaccc

SEQ ID NO: 214899 - DNA, 708 bp, Homo sapiens
  misc_feature: GYAE6OF01C8LSY.1.34.D01.1.454.CMB.1.raw
  modified_base (278)..(278): a, c, t, g, unknown or other
  misc_feature (278)..(278): n is a, c, g, or t
tcagacgagtgcgtcacgaccggtgctcgatttagatcgtctgtgttggggtttgggggagtcagaccctgtcaggacacagcatggacatgagggtccccgctcagctccgtggggctcctgctgctctggctcccaggtaccagctgtgacatccaattgaccctagtcctcactcctcctgtctgcatctagttggagacgagacgtcaacctatctacgtcggccgggacgagtccaggcctatcgagcgtactttcgttacgtccgttggttncgagacgaacgaaaccggaggggccgaccgccccctagaacgtacgtacggtaagttcgtaagtcggtagcaacctcgtaacgtagtacggtacggaacggggttccgggtaccctaacggtccgtaacgggtttaccgaagggttccggagtaaggcgtacgtacgtaccggtagggacctaagtaacttacgtactcgtactactagtaccgagcctacgccttacggactaccggtcttaacggtaaagtttctttaacggaactttaacgtttaacttacgttacgttaacgaacgtttaagtttaaccgttacgtaaacccgttacccgttaaggtaccgggttacgtacccgggtacgggaaaccggtaggtaacgggtacgaaacggttaaccgaaccggtacggttaggtcagtcggtaccc

SEQ ID NO: 214900 - DNA, 529 bp, Homo sapiens
  misc_feature: GYAE6OF01EGW33.1.34.D01.1.454.CMB.1.raw
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (500)..(529): a, c, t, g, unknown or other
  misc_feature (500)..(529): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcatatcagcagcctgcagcctagaagtattttgactaattttattactgtacaactagttaatttaactacgtaccccgttaggtcggtaccggtttccggaccgtaagggggacccgtaaaggggtacgggaaacgtccgaaacccggtaacgttgggtcggccttaggaccaccctagttccgttcgttcttacctacgttcccttacccccgctaattccgtacgaaccgctactgtccgtaggaccgggtcgggtcctaggggacctaaacggggccgtactaaagtaggncgngnnnnnnnnnnnnnnnnnnnnnnnnnnnnnn

SEQ ID NO: 214901 - DNA, 770 bp, Homo sapiens
  misc_feature: GYAE6OF01DMDGW.1.34.D01.1.454.CMB.1.raw
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcagtcaggcatcagcgtattctttagcctggttncagcaagaacgacgggcagcccctanaggatcgtagtctagtggtcactatcagtattcgacgtaagggtccgggtaccagtccgtacggttacacggttggacctaggtcgctagtcgtacgggaactagtactactcttactacgtaacctgtacacgtaccacgcccttggacctaacgtccgtaggttaaacgtttagtttttaccgaaacttttaaacgtttttaacgttacccgttttaacggtaaccttaaaacgttaacgtttttaaacgtttacccgtttaaaacccgggtttaccccccggtttaaacgggttaccgggggtttaaaccccgggtttacccgggggtacccccgggttaaaagggggggggttaaacccccgtaaaagggggggttttaaaaccccgggtaaacgttaaacccccgggtttaaaaaaccccgggtaaacccccgggttttggggtttaaaccccccgggtggttaaaccccgggttaaaccccccg

SEQ ID NO: 214902 - DNA, 638 bp, Homo sapiens
  misc_feature: GYAE6OF01CM95V.1.34.D01.1.454.CMB.1.raw
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
  modified_base (490)..(490): a, c, t, g, unknown or other
  misc_feature (490)..(490): n is a, c, g, or t
tcagacgagtgcgtcacgaccggtgctcgatttagatcgtctgtgttggggtttgggggagtcagaccctgtcaggacacagcatggacatggacgggtcccccgctcagcctccgtggggctcctgctgctctggctcccaggtaccagctgtgacatccaattcgacccagtcctccactccctccctgtctgctatctagttggagacagacgtccaacctatcacgttcggccgggcgtacgtcacggccagtccagtcgtatttcttacgccgtggttgcagcaacggaaccgtggggacgacgcccctanagactacggtagtctagtggtcncactccagtattcggaggtaacggggtcgggtaccctaacgtccgtaggttcaggtcggacaggtcgctaagttcggtagggtaactagtactacctacttctactactactcgagcgtacgccctggacctacggaccttagtaagtttntttacgactttaagtttacttacgtactacaattagttaacttaccgtacgttaaccccgtggtaccggtaccgttacgggaccggtaagggtacccgtagggtacggaaaccgtactaaaccgggtactgggtacgccgtacgtacc

SEQ ID NO: 214903 - DNA, 550 bp, Homo sapiens
  misc_feature: GYAE6OF01AKVY2.1.34.D01.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgattctttagcctggttgcagcagaaaccngggcacgcccctnagatcgtagtctatggtgcatccagtattggcaagggtcgggtacccagtcccgaggttcagtggcagtgcagtcgtagggacagtacttacncttctcactatcagcagcctgcagcctagaatntttgacttaatttactactgtacaactagttaacttataccgttacccctagtacgggtaccgttcgggacccgtaagggggaccctaaaggggttcggaaacgttacccgaaaaccggtaacgttggtacggctcggtaaccc

SEQ ID NO: 214904 - DNA, 667 bp, Homo sapiens
  misc_feature: GYAE6OF01EYCEV.1.34.D01.1.454.CMB.1.raw
  modified_base (102)..(102): a, c, t, g, unknown or other
  misc_feature (102)..(102): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatccctccctgtctgcatctattggagacagagtcacatcacttgccggcgagtcaggccatcagcgtattcttagcctggttgcagcaagaaaccgagggccgacgcccctgacgtagtcgtagtctatcggtnactntaccgagtagttgacgtaagggtcgggtccctagtccgtaaggttcaggtggacaggtcgactacgttacgtacggggaactaacggtacttaaccgtactccttacgaaaccttatcgacgtcacgtcctgaccgtacgaccgttaggaaattacggttttntaaaccttatttttaacgtaccttaggttaacctaaaagttacgtttaaactttaacgttaacccgtacccggtttaccggtacgggtaaccggttccggggtaacccgggtaagggggaacccggtaaaggggttaaccggaaacgtaacccgtaaaccggtacgttaccggtcgggtactcccgtaaaccgg

SEQ ID NO: 214905 - DNA, 569 bp, Homo sapiens
  misc_feature: GYAE6OF01DNHL3.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggcctcctgctgctctggctcccaggtaccagctgtgacatccaattgacccagtctccatcctccctgtctgcatctattggagacagagtcaccatcacttggccgggcgagtcaggccatcagcgtattctttagcctggttgccagcaagaaaccagggcgacgcccctcagatcgtagtctagtggtgcatccgagattggacgtaagggtcgggtccccagtccgaggttcaaggtggcaggtcgctagtcgtagggactagtacttaccgacttctacattactcagacagccttagccagtcctaggtaagtacttttgacttaattttattaccgttagtactaagtacgttaattacgttaaccgtacccttaggtcggtaccgttccggacggtaagggaccgaagggttacgaacgtaccgtaaccgacgtggtcgcgtgaccc

SEQ ID NO: 214906 - DNA, 658 bp, Homo sapiens
  misc_feature: GYAE6OF01AZMG5.1.34.D01.1.454.CMB.1.raw
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaccgagggcgacgcccctnagatcgtagtctagtggtncatccagattgcgaagggtcggtcccagtcccgaggttccaggtcggctaggtcgctagtcgtagggaacagtacttacgactactcaactactacacgcacggccttaggacctacggtacccttaggaaacgtttacgttttacggaactttaaatttttaacgttacgttaacgttacctaaacgtagtttaactttaaccgttaccggttaacccccgttaagggtttacgggtacccggttttaccgggacccggttaacggggggtaaaccgtaaaggggttaccgggtaaacggttaccccgtaaaaccgggtaacttacggggtacggttacccggtgtaaacccccg

SEQ ID NO: 214907 - DNA, 690 bp, Homo sapiens
  misc_feature: GYAE6OF01EQSAR.1.34.D01.1.454.CMB.1.raw
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (438)..(438): a, c, t, g, unknown or other
  misc_feature (438)..(438): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctattggagacagacgtccacctatcacgttcggccgggcgagtcgacggccatcgagtcgtaattcgtttagcttggttcncagacaagaaaccgnggcgacgcccctgacgtatcgtagtctagtggtgctancagtatgacgtagggtcggaccctagtccgtaggtcaggtcgcgagtcgactagtcgtagggactaacgtacttaaccgtcctctacgtaactagaccagtccaacggtccncggtactaccggtaccgtaaggttaactttacgttttacggaactttaacttttaacgtaccgtttaacgttaacctaaacgtttaatttaaaccgtttaacggttaaccccggttaaccccgttaggggttacccggtaacccggggttccgggtaacccggggtaaacggggtaacccgtaaagggggtaacccgtaaaggtaaccccgtaaaccgggttacggtagggtccgtccgtacgggtaacccc

SEQ ID NO: 214908 - DNA, 903 bp, Homo sapiens
  misc_feature: GYAE6OF01CDW3Z.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattcgacccagtctccatccctccctgtctgcatctagtggaagacagacgtaccaccatctacgttcggccgggacgagtcaggccatcgagcgtatttcttacgccgttggttgaccagacgaacggaaaccgacgggccgaccgccccgtagacgtacgttacggtacgttcgtaaggttcggtacgacctacgtacccgaaggttacgtttacggaccggtaacgggggttcccgggttaacccctaaccgttacccggtaacggggttttacgtaacgggttcgggtaccgtaacggttacggtaccgttaacgtttcccgggtagggaaaccgttaaggttaacccgtttaaccgacccgtttaccgttaaccgtaaacctttaacgtacccggtaagacccgtccggtacccgtacgtaccggtaccggtaacccgtttaggtaaacggttttactttttaaccgtaacgttttaaattttttaaccgttaccgttaaccggttaaaccttaaaccggtttaaagttttaacccgttttaaaccggttaaacccccgggtttaacccccgtttaacgggggtttaaacccgggttacccggggttaaccccggggtaacccggggttaaccggggggttaaacggtaaaccggggtttaaccgggtaaacgtaaacccccggttaaaccgggttaacccggtttaggggtaacccgggtccgtaaccgggtaaccccccg

SEQ ID NO: 214909 - DNA, 506 bp, Homo sapiens
  misc_feature: GYAE6OF01AZZ2V.1.34.D01.1.454.CMB.1.raw
  modified_base (385)..(385): a, c, t, g, unknown or other
  misc_feature (385)..(385): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagccccctcagatcgtagtctatggtgcatccagattgcaaggtgggtcccatccaggttcaggtggcagtgcatctgggacagattacactctcactatcagcagcctgcngcctgaagtattttgactaatttattactgttacaactagttattactacgtacccctagtcggacgttccggccgtaggggaccagggtacggaacgtacaaccggactagtggctgacc

SEQ ID NO: 214910 - DNA, 754 bp, Homo sapiens
  misc_feature: GYAE6OF01B4HRT.1.34.D01.1.454.CMB.1.raw
  modified_base (212)..(212): a, c, t, g, unknown or other
  misc_feature (212)..(212): n is a, c, g, or t
tcagacgagtgcgtcacgaccggtgctcgatttagatcgtctgtgttgggtttgggggagtcagaccctgtcaggacacagcatggacatgacgggtcccccgctcagctccgtggggcctcctgctgctcgtggcctcccaggtaccagctgtgacatccaattcgaccctagtcctcccactccctccctgtctgctattctagttgganacgagtcgtaccaccatctacgttcggccggggcgacgtcgacggccatcgagcgtatttcgtttacgccgttggttcgcgacgacgaacgaaccggacgggaccggtacgcccctagacgtacgtcggttagtcttaaggtcggacgtacctacgtaccgtagtacgtcggaacggtacggggtccgggtaccctacggtcgtacggttacgacggttaggccgtaggtcgaccgtagttcgggtacggggactaacgtaccttaacgtacctaccgtactaccttagaccgtacgcctcgtcctacggtccgacgtaccgtaaggtaacgttttacgtttacgttaacgtttaacgtttttacgtacgttaccgttaataaaccgttagttaacctttaccggttaaccggtttaccccgttaggggtttaccgttacccgggttaccgggaccggttaacgggggaaccgttaacggggtaaccggtaaaccgtaaccccgtaaacgaccggttaggtaccggtaccgccgttaaaccg

SEQ ID NO: 214911 - DNA, 664 bp, Homo sapiens
  misc_feature: GYAE6OF01EB9BN.1.34.D01.1.454.CMB.1.raw
  modified_base (102)..(102): a, c, t, g, unknown or other
  misc_feature (102)..(102): n is a, c, g, or t
  modified_base (444)..(444): a, c, t, g, unknown or other
  misc_feature (444)..(444): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctatggagacagagtcaccatcacttgccgggcgagtcaggccatcagcgtattctttagcctggttgcagcaaggaaccgaggcgacgcccctgagtacgtcgtagtactagtgggtacgctactccgaaggtacgtttcggacgtaaacgggggttcggggtacccctaagttcccgtaagggtttccaagggttcggacgtagtcgactaacgtcggtacggggaacctaaggtaacctttaaccgccttacnctaacttatccgagacacgtcctgaccgtacgtccgtaaggtaacgtttaagtttcgtaacttaacgtttttacttaacgtcgttaaacccaaagttacgttaactttaacgtaaccggttacccccgttaaggtcgggtaaccggttccgggaaccgtaacggggaactaaggggtacgaaagtacccgaaacgaacggttggtaccgtcgcgtaaccg

SEQ ID NO: 214912 - DNA, 550 bp, Homo sapiens
  misc_feature: GYAE6OF01EN4GB.1.34.D01.1.454.CMB.1.raw
  modified_base (102)..(102): a, c, t, g, unknown or other
  misc_feature (102)..(102): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccngggcagcccctnagatcgtagtctatggtnaatccagattgacaagggtggggtccatcaggttcagtggcagtgcatcgtagggacagtattacactactcactatacagcagcctgcagcctagaatattttgactaattttactaacttgtacaaactagttaattaactacgttaccccttaggttacggtacggttacgggcccggtaacggggaaccgtaaagggtgggaaacgttaccgaaacccggtaacttaggtgggacttggacctaaaccg

SEQ ID NO: 214913 - DNA, 815 bp, Homo sapiens
  misc_feature: GYAE6OF01A6MNB.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctcctggggcctcctgctgctcgtcggcctcccgaggtaccagctgtcgacactaccaattcgaccctagtcctccactccctcctgtctgctatctagtggagacagacgtcacctatcctacgttcggccgggcgacgtcgacggccagtcgagcgttactttcgttacgccgttggtcgacgagacgaacgaaccggcggccgaccgccctagacggtacgttaccgtacgttacgttagtcggtacacgtactaccgtagtacgttacggacgggtaacggggttcccgggtaaccctacgttaccggttaggtaccgtacgggtcgggtaccgtacgggttcgaccgttacggtcggtaacgggaaccgtacgttaaccttaccctaccgtttacgtaaccttacgttaacaccgtaacgcgttaacccgcctaggtacccgtaacgttaccggttaggtttaaactttcgtttaagttaaccctttaagtttttaaccttacgtaacctaacgttaacgtttaacgtttaaccgtttaacccgtaaccccgggtttacccgttacggggttacccggggttaaacccggttaccgggaacccgggggttaaacggggtaacccggtaaaggggttacccggtaaaccgtaacccggttaaaaccgttccggggtaggttacccggtccgttaacgtaacccg

SEQ ID NO: 214914 - DNA, 730 bp, Homo sapiens
  misc_feature: GYAE6OF01DNLWS.1.34.D01.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacataccaattcgacccagtcctccatcctccctgtctgcatctatgganacagagtcaccatcacgttggaccgggcgagtcacggccatcgagcgtactttacgtttacgccgttaggttcgacgacgacgaacggaaaccgacgggccaaccggtcccctagaagtacgttcggtagtctagtcggtcactactccgaagtacgttacgacggtaaggggttccgggtaccctacgtaccggtaggttcgaggtcggcgtagtcgctacgtcggtacgggactaaggtaacttacgaccttaccgtactaacgtttacaccgaagtacccgtacggtccgtacggaccgacgtaccgttaaggttaaacgttttacgtttacgtaacctttaaaagttttaccttaacggttactaacctaaagtttaactttaagttaacccgttaacccggtacccgttaacgggtccggttaacccgggtacccgggaacggttaaaccgggggaaccgttaaacggggtacgaaacggttaccgtaaccggttacggaaaccgttcgggtaccgtccgtaacccg

SEQ ID NO: 214915 - DNA, 655 bp, Homo sapiens
  misc_feature: GYAE6OF01DMB2S.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaccatcacttggccggcgagtcaggccatcagcgtatttcgtttagccttggttcgacagcaacgaaaccgaggggaccgacgcccctagagacttcggtagtctagtggtcgcatccagtattggacgtaacggggtcggtacccagttcccgaggttcaaggttggacctaggtcgactacggtcgtacggggaactaaggtactttaacccacttcctaactactaactcaagctaccgcctcgtacaccgtcttaaggtaattacttttacgaactttaaattttacttaacgttcgtaactaacgttaacgtttaattacgtaaccgttaccccgttaggtaccgggtacggttaccgggaaccggaaggggtaaccgtaaggggttacggtaaaccgttaaccgtaaaccggtaacgttgggtaccggcgttcggtaaccccg

SEQ ID NO: 214916 - DNA, 614 bp, Homo sapiens
  misc_feature: GYAE6OF01CUQEB.1.34.D01.1.454.CMB.1.raw
  modified_base (102)..(102): a, c, t, g, unknown or other
  misc_feature (102)..(102): n is a, c, g, or t
  modified_base (203)..(203): a, c, t, g, unknown or other
  misc_feature (203)..(203): n is a, c, g, or t
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattgacccagtctccatcctccctgtctgcatctattggagacagngtcaccatcacgttgccgggngagtcaggccatcagcgattcttagcctggtgcagcaagaaaccgagggcgaacgcccctnagntcgtagtctagtggtnaccatccgagtagtttacgacgtaaggggtcgggtcccaagtccgaaggttccaggtggcaggtgctaagtgtagggacagtacttacgactctaccactatacgacgacgagaccgtgactacgtacctaggaaagttatttaggtaacttaaagttttaacttaccgtaagttacctaaacgtagttaacttaacgtaacgtaccccgttaggtacgggtaccgtttccgggaccgtaagggggaaccttaaggggtaacggtaacgtaaccgtaaaccggtacgttaggacggtcgtacggtaaccc

SEQ ID NO: 214917 - DNA, 690 bp, Homo sapiens
  misc_feature: GYAE6OF01B61CP.1.34.D01.1.454.CMB.1.raw
  modified_base (126)..(126): a, c, t, g, unknown or other
  misc_feature (126)..(126): n is a, c, g, or t
  modified_base (216)..(216): a, c, t, g, unknown or other
  misc_feature (216)..(216): n is a, c, g, or t
  modified_base (288)..(288): a, c, t, g, unknown or other
  misc_feature (288)..(288): n is a, c, g, or t
  modified_base (463)..(463): a, c, t, g, unknown or other
  misc_feature (463)..(463): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctntggctcccaggtaccagctgtgacataccaattcgacccagtcctccactcctccctgtctcgctatctattggagacagagtaccaccntcacgttggccgggcgagtcgacggccatcgagcgtattcgttagccgttggttgcagacaacggaaccggngggacgaccgcccctagagtacgtcgtagtctaggtcgcgactacttacgagtagtacggacggtaacgggttccggtaccacgttacccggtaggttcgacggttaggaccgaggttagacctaggtacggtaggaactagtacgttaacctactctaacactactcgacgacnggcctgacctcgtaccgttagtaacgttagtttacgactttaaatttaaccgttacgtcgtaaacgtaacgttacgttaaaccgttacgtaaaccccgttaccggtaaccgggttacgggtacccgggttaacgggacccgggtaaggggtacccggaaacgggtaggggtaaaccctaacccgggaaaccgtaacgggttaggtaccggtcgtacgttaaaccccg

SEQ ID NO: 214918 - DNA, 753 bp, Homo sapiens
  misc_feature: GYAE6OF01C9LA9.1.34.D01.1.454.CMB.1.raw
  modified_base (227)..(227): a, c, t, g, unknown or other
  misc_feature (227)..(227): n is a, c, g, or t
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattcgacccagtctccatcctccctgtctgcatcttatggagacagagtcacctatcacttcggccgggnagtcaggccagtccgagcgtattctttagccttggttgcagcaacggaaaccgagggaccgacgcccctgaagctcggttagctagtcggtgctacgtccaggtattacggacgaaggggttccgggtaccctacggttaccgtaggttacgaggttacgggcgtaaggtcgacgtaacgtcgggtacggggaacaacggttaacttacccggaaccttcgttaacgtacttaagttaccgaacggactaacggtcccgtacggtaccgaaccgtcccgttaaggtaacggttttaacttttacggtaacctttaaaagtttttaccgttaacgtttaccgttaactaaaactttacgtttaaacgttttaccgtaaacccggtttaccccttaaagggtaccgggttaccggttacccggggtaaaccggtaacgggggtaccgggtaaaacgggttaaacccgggaaacgttaacccggtaaaccgggtaaaccgttgggtcccgtaagttccgggtaaacccc

SEQ ID NO: 214919 - DNA, 708 bp, Homo sapiens
  misc_feature: GYAE6OF01EC8CF.1.34.D01.1.454.CMB.1.raw
  modified_base (101)..(101): a, c, t, g, unknown or other
  misc_feature (101)..(101): n is a, c, g, or t
  modified_base (200)..(200): a, c, t, g, unknown or other
  misc_feature (200)..(200): n is a, c, g, or t
tcagacgagtgcgtcacgaccggtgctcgatttagatcgtctgtgttgggtttgggggagtcagaccctgtcaggacacagcatggacatgagggtccccntcagctcctggggctcctgctgctctggcctcccaggtaccagctgtgacatccaattcgacccagtctccatcctccctgtctgctatcttagtgganacagtacgtccaaccatcctacgttcgggccgggacgacgtcgacggccagtcaggtcgtatttctttacggccgttggttcgactagacgtaaacggaaaccggcggggtaccgaccgccccctagaaggtacgttcggttagtcgtagtggtacactagtaccgagtacgttcggacggtaacggggtccgggtacctagtcccgtaggttacgaggttcggactaggtcgacgtacgttcggtacgggtaacacgttacttaccgtactactacgtaactactacgacgtacacgtccgtacgaccggtacgtaccgttaagttaagtttactttacgtaactttaacttttacgttaacttacgtaaccttaagttacgtttaacttaccgttaacccggtacccgttagggttaccggaccggttccgggaaccgggtaagggaacgttacgggaacgggtaactaccgtaaccggtaagttccggtacggtctcggtaaccc

SEQ ID NO: 214920 - DNA, 741 bp, Homo sapiens
  misc_feature: GYAE6OF01D6BID.1.34.D01.1.454.CMB.1.raw
  modified_base (419)..(419): a, c, t, g, unknown or other
  misc_feature (419)..(419): n is a, c, g, or t
  modified_base (724)..(724): a, c, t, g, unknown or other
  misc_feature (724)..(724): n is a, c, g, or t
tcagacgagtgcgtcacgaccggtgctcgatttagatcgtctgtgttgggtttgggcatggacatggacgggtccccgctcagctccgtggggctcctgctgctctcggctccaggtaccagctgtgacataccaattacgaccctagtcctccactccctccctgtctgctacttactagtggagaacagacgcacatcacgtcggccggagacgtacgacggcctagtacgacgactacttttaccgttagccgtggttacgaccaagaaccgaacgaaaccggacggaccggaccgaccccttagaacggtacttccggtaagttccgtaggtcggttacacctagtaccaggtattaccggacggtacgggtaccgggtaccacgtttaccgagggttacctagggcggactagngactaaggcgtaggactatacgtactctaacgtactaactacaccgtaggacctcgacgtacgaccacgttacgaagttaaacgttagttttaaccaacggtttaacttttacgtaacgtacgttaaacaacgtttactttaaactcggttaaacccttaacccggttaacgggtccggtaacggttcgggaaaccggtagggtaacccggtaaggtaaccggtaacgtaaccggaaccgtaacggtacggtacggtataccggaccttaaacggtgttaccggttacttacgtaccctttaccnccggttaaccccgtacg

SEQ ID NO: 214921 - DNA, 946 bp, Homo sapiens
  misc_feature: GYAE6OF01CHN8L.1.34.D01.1.454.CMB.1.raw
tcagacgagtgcgtcacgaccggtgctcgatttagatcgtctgtgttggggtttgggggagtcagaccctgtcaggacacagcatggacatggacgggtccccgctcagctccgtggggctcctgctgctctggctcccaggtaccagctgtgacactccaattcgaccctagtcctccactccctccctgtcctgctatcttagtaggaagacagtacgtcaccactcctacgttcggccggggacgtacgtcgacggtacacgtcgagtcgttacgtttcgtttacggccgttggttgacgacgacgaacggaaaccggacggggaccgaccggtaccccgtacgaacggtacgttacggttaacgttcgttagggtggttaccgacttaaccgtacgtaacgttaacggttaccggtaacgggtaacgggggtttacccgggtacccgtaacggttaccggttaagggtttacgtaacgggttcgggacgtaacgggtcgtacgtacgttaccgggtacgggtaactaggttaacctttacccgtaacttaccgtactaaccggttactacgggacctaaccgggtcggttaccctagggtacccctaacgggttaacccgtttaagggtaaagttttaacggtttttaacgaaaccgttttttaaaactttaccgttttaaaccgtaacgggtttaaaccttaaaacgtttaaacgttttaacccgttaaaccgggttttaaaccccccggtaaccccgggtttttaacggggaccggggtttaaaccccggtttacccgggggaaaccccggggtttaaaacgggggtacccggggtaaacgggggttttaaaaccgggggtaaaccccggtttaaaccccggtaaacggggttaacccgggttaggggaaccccggttccgggtaaacccgtaaaccccg

SEQ ID NO: 214922 - DNA, 656 bp, Homo sapiens
  misc_feature: GYAE6OF01CH2V4.1.34.D01.1.454.CMB.1.raw
  modified_base (226)..(226): a, c, t, g, unknown or other
  misc_feature (226)..(226): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatccctccctgtctgcatctattggagacagacgtcaccatcacttcggccggganagtccaggccagtcagcgtattcttttaggccttggttcgctagaccaacgaaaccgagggaccgacggcccctacgagtactacggtagttctagtggtgacctataccgtagagttacggcgtaaacggggttcgggtacccacgttccggtaacggttcgaggttcggctaggtcgacgtacgtcgtagggaacaagtacgttacacttctacacttactacgaacgactagtccgtcgacacgtcgtagtaacgttatttacgactttaaagtttacttaccgtagttaacaaacgttacgttaattaccgtaccgttaaccccgttacgggttaccggtacggttacccgggaccggtaacggggaacgttaacgggtaacggtaacgttaaccgaaacgtacggttacggcggtctcggtaccc

SEQ ID NO: 214923 - DNA, 797 bp, Homo sapiens
  misc_feature: GYAE6OF01BBWEF.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccagctgtcgacactccaattcgacccagtcctccatccctccgtgtctgcattcgtaattggagacagtacgtccaacctatccgacgttcggccgggacgtagtccgaggccaatccgagtctactttcgtttacgccgttggttcgaccgaagcgaaacggtaaaaccgacggggtaccgtaccgtcccctacgaacgtacgttccggttaacgtccgtaaggtcgggtacacctaacgttcgaagttaacgttggaacccgtaacgggggttccggaccccttaacgtcggtaaccggtttcgaacggttcggaccgtagtaccgtacgtacgttaccgtacggggtaacctagtaacttaaccctacgtaccgtacgtaacgttacgtacgaacggtacgtaacgtccgtacggacctaacggtcctaaggttaacgtttatttaccggtaacttaacgttttaacgttaccgtacggttaaactaaaccgtttagtttaaacgtttaccgttaaccggttaacccccgtttagggtaaccgggttacccggttaccgggacccgggtaaaggggtacccgttaaagggggtaccgtaaacggttaacccgtaaaaccgggttcttagggtaccgtacccgttcgggtaaaccc

SEQ ID NO: 214924 - DNA, 730 bp, Homo sapiens
  misc_feature: GYAE6OF01DKJTU.1.34.D01.1.454.CMB.1.raw
  modified_base (237)..(237): a, c, t, g, unknown or other
  misc_feature (237)..(237): n is a, c, g, or t
  modified_base (289)..(289): a, c, t, g, unknown or other
  misc_feature (289)..(289): n is a, c, g, or t
  modified_base (336)..(336): a, c, t, g, unknown or other
  misc_feature (336)..(336): n is a, c, g, or t
tcagacgagtgcgtcacgaccggtgctcgatttagatcgtctgtgttgggtttgggggagtcagaccctgtcaggacacagcatggacatggacgggtcccccgctcagcctccgtggggctcctgctgctctggctcccaggtaccagctgtcgacatccaattcgaccctagtcctccatccctcctgtctgctactctagtggagacagactcaccatcgacgttcggccgggngagtcgaggcagtcgagtctatttcttacgcgtggtgcagacaagaaccggnggccgtaccgcccctagaacgtacgtacgttacgtcttagtggtacncctaacgtcctaggtagttcggaacggtacggggtccgggtaccacgttaccggtaggttacgagggtcggacgtagggtctaccgaggttacggtagggaactaacggtacttaaccgtctacgtacattaccgacacggtcacgtcctacgacacgtctaaggtacttttactttacgtaattttaacttttacgtaccttacgtaaacgtaaacgtttacgttttaaacgtttaacccgttaacccggtacccgtttaaggggttaccccggttaacgggtacccggggaccgtaaagggggtaaacccgggttaaacggggttaccgggtaaaacgtaacccggttaaaccgggtaccgttacgggtccgggtacctaaccgggtaaccc

SEQ ID NO: 214925 - DNA, 618 bp, Homo sapiens
  misc_feature: GYAE6OF01BVXN1.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggttgcagacaagaaaccgaggggcgacgccccctgacgactcgtagtctatggtacgtcactccagtagttcggacgaacgggtcggggtacccagtcccgtaaggttccaaggtcggctagtcgctagtcgtaggggaacaggtaacttacacttctactactatcacgcagccctgacacgtcctagtaacgttacttttagacttaattttattacgtagtacctaaacgtagttaacttacgtaaccgttacccccgttaaggttcgggttaacccggttcccgggacccggtaagggggaaccctaaaggggtacggaaaccgttaccgaaaccggtagttcggtaggcctaggtaccc

SEQ ID NO: 214926 - DNA, 861 bp, Homo sapiens
  misc_feature: GYAE6OF01E03HA.1.34.D01.1.454.CMB.1.raw
  modified_base (226)..(226): a, c, t, g, unknown or other
  misc_feature (226)..(226): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtctccatccctccctgtctgcatctattggagacagagtcaccatcacttggccgggngagtcaggccatcagcgtactttcgtttacgccgttggttcgacagacgaacggaaaccgaggggaccgtaccgccccctacgacgtacgttaccgtaggttccgttaggtcgggtacggacctacgttaccgaaggtacgtttacggaccggtaacgggggttccgggttacccccgtaacgtcccggttaacgggtttccgaacgggttcgggaccgtaggtacggtacgtacggttaccggttacggggtaaccgtaagggttaaccttaacccgtaaccctttccgtaaccctaaccttaacgtaccgaacggacccgtaaccggtacccgtagggtaacccgtaacggttacccgttaagggtaaaaccttttacggttttttacgaaccttttaaacgttttttaaccttaaccggtttaaccggtaaaccttaaaaccgtttaggttttaaacctttaaccggttaacccgttaacccccggtttacgggttaaaccggggttacccgggtttaccggggaaccccggggaaagggggttaaaccccgggtaaagggggtaaccggtaaaccggttaaccccgaaaacgggttaacggttacgggtcgggtaaccgtcggtaaacccc

SEQ ID NO: 214927 - DNA, 402 bp, Homo sapiens
  misc_feature: GYAE6OF01AJN3A.1.34.D01.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
  modified_base (326)..(326): a, c, t, g, unknown or other
  misc_feature (326)..(326): n is a, c, g, or t
  modified_base (386)..(402): a, c, t, g, unknown or other
  misc_feature (386)..(402): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgactaatttatacctgtacaanagtattactacgtacccctagtggacgttcggccgaggggaccaaggtgaacgtcaaccgatgtcggctgcacntctgtctcactctcccgcatctgaacgcactcgctgacgcgggctggcgaggcacatagnnnnnnnnnnnnnnnnn

SEQ ID NO: 214928 - DNA, 476 bp, Homo sapiens
  misc_feature: GYAE6OF01D50MA.1.34.D01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (237)..(237): a, c, t, g, unknown or other
  misc_feature (237)..(237): n is a, c, g, or t
  modified_base (436)..(437): a, c, t, g, unknown or other
  misc_feature (436)..(437): n is a, c, g, or t
  modified_base (440)..(476): a, c, t, g, unknown or other
  misc_feature (440)..(476): n is a, c, g, or t
tcagacgagtgcgtcacgaccggtgctcgatttagatcgtctgtggttgggtttggggagtcaggccatcagcgattctttagcctggttgcagcagaaaccagggcgacgcccctcagatcgtagtctatggtgctatccagattgcaagggtgggtcccatccaggttcagtggcagtgcatcgtgggacagtattacactcncactatcanccagcctgcacgcctagaagttntttgacttaattttatactgtactaaactagtattatacgtacccctaggtggacgttccggccgaaggggaccaaggggtggaacgtccgaaccgtatggtagctcgcctaccagttcgtagttccttacgtactccgttcccgcctatcgtacgaacgcacgtcgtcaggtcggcggactcggacaggcacagtagnngannnnnnnnnnnnnnnnnnnnnnnnnnnnnnnnnnnnn

SEQ ID NO: 214929 - DNA, 563 bp, Homo sapiens
  misc_feature: GYAE6OF01DXELS.1.34.D01.1.454.CMB.1.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
  modified_base (310)..(310): a, c, t, g, unknown or other
  misc_feature (310)..(310): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcgagtcaggccatcagcgtattctttagccttggttgcagcaacgaaaccgngggccgacgcccctagagagtcgtagtctagtggtncatccagtattgacgtaacggggtcgggtacccagtccgaggttcaggtcggactagtcgactagtacgtagggaacagtacttaaccncttactctaactatcagcacgctgcngtctagattatttcgattaatttacttactagtacaaacttagttaattacgtaaccgttaccccgttaggtacggtacgttacgggaccgaggggtaacaagggtacggaacgtacgaaccgtagtggcgcgtgacc

SEQ ID NO: 214930 - DNA, 641 bp, Homo sapiens
  misc_feature: GYAE6OF01DNVWJ.1.34.D01.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
  modified_base (503)..(503): a, c, t, g, unknown or other
  misc_feature (503)..(503): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattcgacccagtcctccactccctcctgtctgctatctagtgganacagacgtcacctatcacgttcggccgggngacgtcgacggaccatccgagcgtactttcgttacgccgttggttcgcagacgaacggaaaccgngggacgacgcccctagagactcgtatctagtcggtgctacgtccgagtagttggacggtaaggggttccggtacccagttacccgtaggttaccgagggtcggcgtacggtcgacgtacgttcggtacgggaactaagttacttacctactcctactactatcgaacgtctaacgtcctacgacgacgtacctaggtaaactttnttttacgaacgtttaattttacgtacgtacgtaacgtaacttagttaacgttacgtaccgttacccgtaggtacggtaccgtacggacggtagggaaccgtagggtacgacgtacgaacggtataggngtcngtaccg

SEQ ID NO: 214931 - DNA, 695 bp, Homo sapiens
  misc_feature: GYAE6OF01E5JYS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttggccgggcgagtcaggccatcagcgattcttagcctggttgcagcagaaaccgagggcgacgccccctcagtactcgtagtctagtggtcgctatccagtattgacgaaggtcgggtccatccgaggttcaaggtggactaggtcgacagtcgtcggggaacacggtaattaaccaaccgttccttacaaccttataccgacggtccgtaacgcccgttaggacccgtaacggtacccgttaagggtaaacgtttagtttttacgaaccttttaaagtttttaacttacgtttacgttaaccgtaaacgttaagtttaactttaacgttaaacccggttaacccccgttaacggttaccggggtaacccgggttttaccggggacccggttaaccgggggtaaaccggtaaacggggttaccggtaaacggttaacccggtaaacccggtacggttacggtcgggtccgtcggtaaccccg

SEQ ID NO: 214932 - DNA, 562 bp, Homo sapiens
  misc_feature: GYAE6OF01ELGFK.1.34.D01.1.454.CMB.1.raw
  modified_base (305)..(305): a, c, t, g, unknown or other
  misc_feature (305)..(305): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttggccgggcgagtcaggccatcagcgtattcttagcctggttgcagacaagaaaccgagggccgacgcccctgagatcgtagtctagtggtnacactccagtattgacgtaagggtcgggtacccagtccgtaggttcaggtcggcgagtcgctagtcgtagggactagtactacactcactactatcagcacgcctagccacgtccgtagtaagttntttacgacttaatttactactcgtaactaacgtattactttaacgtaccgtacccgtagggtccggtacggttccggaccggtagggaaccgtaggtacgactaaccggaaccgtactggtcgctgaaccg

SEQ ID NO: 214933 - DNA, 743 bp, Homo sapiens
  misc_feature: GYAE6OF01C4VZL.1.34.D01.1.454.CMB.1.raw
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttggccgggcgagtcaggccatcagcgtattctttacgccgttggttcgcagcaaggaaaccgaggggccgacgcccccgtanagtactcgtagtctagtggtgctactccagtacttgacgtaacgggtcgggtacccagtcccgtaggttcgaggtcggctaggtcgtacgtagttaccggttaggggaacctagggtaactttaaccaccctttacctacctaacgtttacgttaccgaacggtaccgacggtccccgtaggaccgtaacggtcccttaaggtaaacgtttactttttacggtaacttttaaatttttacgttaaccttacgtaacctaaacgttaaggttttaacttttaacggtaacccgtttaaccccccggtttagggtaccgggttaacccggtttacccgggggacccggtaaacgggggtaaaccggtaaacgggggttacgggtaaaaccgttacccggtaaaacccggttaaccgttacggggttaccgggtcgttaccggtaaccccg

SEQ ID NO: 214934 - DNA, 709 bp, Homo sapiens
  misc_feature: GYAE6OF01ALBER.1.34.D01.1.454.CMB.1.raw
  modified_base (271)..(271): a, c, t, g, unknown or other
  misc_feature (271)..(271): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccgngggcacgcccctgagactcgtagtctagtggtcgcatccagtattcggacgaaggggtcgggtccagtccgtaggttcaggtggctagtcgctacgtccgtaggggacctaaggtacttaacgacccttctaccgtaacttactccgaacgactaccgtcctacggtaccacgttccgttaaggaaacgttttacgttttttacggaaccttttaaacgtttttacttaaccgtttaggttaacccgttaaaacgtaagtttaaccgtttaaaccgttaaccccggtttaaccccggttacgggttaccgggttaaccgggtttaccccggggaaccggtaacgggggggtaacccgttaaagggggttaccggaaaaccgggttacccgtaaaaacccgggttacgtaccgggttacggtcccgttccgggtaaccc

SEQ ID NO: 214935 - DNA, 796 bp, Homo sapiens
  misc_feature: GYAE6OF01BR8Y3.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatcctccctgtctgctatctagttggaagacagacgtcaacctatacctacgttcgggccgggacgtacgtcgacggccatcgagcgtatttccgtttacgccgttggttcgacgtacgacaaacggaaaacccggacggggaccgaccgtcccctagaacgtactcggtagtctagtgggtcgacactccgagtagttcggacggtaagggggttccggtacccaacggttcccgtaagggttacgaggtggcctaaggttcgactacggtacggtacgggaacgtaggttacttacctaccgttccgactaaccttagtaccgaagtaccgacggtcctacggaccgtacggtaccttaagggttaacgtttacgtttttaagacgttttaaacttttacgttacccgttacggtaaccttaaacgtttaaacgtttaacgtttaacggtttaacccccgtttaacccgggttacgggtttacccggggttaacccggtttcccggggaaccgggtaaaccggggggtaacccgttaaagggggtacgggtaaacccgttaaacccggtaaaaccgggttaacccggttgggtaaccgggttccgtccggtaaacccccgg

SEQ ID NO: 214936 - DNA, 777 bp, Homo sapiens
  misc_feature: GYAE6OF01DABL0.1.34.D01.1.454.CMB.1.raw
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (588)..(588): a, c, t, g, unknown or other
  misc_feature (588)..(588): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggcctcctgctgctctcggcctcccgaggtaccagctgtgacactccaattcgacccagtcctccactccctccctgtcctgcattctagtggaacgacagtacgtaccaaactacttaccgtacgtttcgggacccggggacggtaacgtccgacgggacccaagttccgaacggttaccgttacttttaccgtttaccggtccgtttggggttcgaccgtaacggtaccgaaaaccggaaaacccgggacggggaccccgtacccggtaccccccgtaagtaacggtaccgttaccgggtttaacgtaccgttaggttcggtactacctacgtaccgtagtacgttacggacggtaacgggttccgggtaccctacgtaccggtacggttacgaggtcgacgtagtcgactacggtcggtaggactagtacttaccncttacnctacgtacgtcgaacgtcgacgtcgngacccgagtacgttaacgtactttacgtttcgtaaactttagtttaacgtaccgttagtaacctaagttacttaacgttaccgtaccgttaccccgttagggacccggttacggtaccgggacgggtaacggtacccggtaagggtaccgtaaacgtaccgtaacgtacgttggcgtcgtcgtaacccg

SEQ ID NO: 214937 - DNA, 838 bp, Homo sapiens
  misc_feature: GYAE6OF01AV8M2.1.34.D01.1.454.CMB.1.raw
  modified_base (129)..(129): a, c, t, g, unknown or other
  misc_feature (129)..(129): n is a, c, g, or t
  modified_base (246)..(246): a, c, t, g, unknown or other
  misc_feature (246)..(246): n is a, c, g, or t
tcagacgagtgcgtcacgaccggtgctcgatttagatcgtctgtgttgggtttgggtaggtcgtagaccctgtcaggacacagcatggacatgagggtccccgctcagctcctggggctcctgctgctntggctcccagtaccagctgtgactatccaatgacccagtctccatccctccctgttcctagctactctagttggagacctagagtccacctatctacttcggccgggcgtagtccgnggaccctatcacgcgtacttcttagtcccttaggttcgctagccgtaagaacccgagggcgaccgaccccctgaagtactacggtagtccgtaatgggtaccgtacacgttaccgaggtacttacggtcgtaacgggggttacggggaccctaaggtaccccgttaggttcccggaagttccgggacgtaagtcggtaccgtacgtcgggttaacgggactaacggtacttaacgtaccttaaccgtcccgtaacttactaccggtaagtacccgtaacgggtccccttaccgggtcaaaccgggtccgtttaacgtaacgtaacgggttttttaacaccggtttaaacttttttaaccggtttaacttacccggttagtttaaaacccggtacgttttaaaacggttaactttaaaaacccgggtttccccgtaaaaccggttttacccgggtaaaccgggtttacccggtaaccggggttaaccccggggtaacggttaaaaccggggtacggggtttaaaacccggttaaccggtaaaaccgtaaccccggggttaaacggtttacgggtaccggtttacggaacccgg

SEQ ID NO: 214938 - DNA, 686 bp, Homo sapiens
  misc_feature: GYAE6OF01CRMGU.1.34.D01.1.454.CMB.1.raw
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
  modified_base (492)..(492): a, c, t, g, unknown or other
  misc_feature (492)..(492): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggcctcctgctgctctcggcctcccgaggtaccagctgtcgacataccaattcgacccagtcctccactccctccctgtctgctatctagttggagacagacgtaccaccatctacgttcggccgggacgacgtcgacggccatcgagcgttatttctttacgccgttggttcgcacgacaacggaaaccggngggccgaccgcccctagagtacgtcggtagtctagtggtcncatccgagtagtcggacggtacggggtcgggtacctacgtccggtacggttacgaggtcggacgtacggtcacgtacgtcggtacgggaactacgttaaccttaaccgaccttcctactaataccacgacgacacgtccgngaccgtcgtaccgtaagtaacgtttactttacgtaactttaacctttattaccgtagttaacctaattacgttaactttacgttacccggttaccccggtaggtttccgggacccggttaccgggaccgggtaacgggtaaccggtagggtaccggtaacgtacccgaaacggtggtcgacgtccgtagacccg

SEQ ID NO: 214939 - DNA, 808 bp, Homo sapiens
  misc_feature: GYAE6OF01DQZ5S.1.34.D01.1.454.CMB.1.raw
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattcgacccagtctccatccctccctgtctgcatctatggagacagacgtccaacctatccacttcggccgggacgtagtccaggccatcgagcgtattctttagccttggttgacagacaacgaaaccgngggcgtaccgccccctgagagttccgagtctagtggncatccgagagttcgacgaacggggttccgggaccctagtacccgtaggtttaccaggtttacgggacctaagggtcgaccgtacgttaccgggtacggggaaaccgtaacggttaaacgtttaccccaaccgtttaccccttaaccggtaaacgttttaccctaccgaaccgtacccggtaacccggttccccgttaaggacccccggtaacggtttaccccgtttaaaggggttaaacccggtttttacttttttaagggaacctttttaaaacgttttttaacgtttaccgttaacgggttaacctaaccgtttaaagttttaaccgttttaacgttaaaccccggtttacccccgtttaaggggtacccggtttaacccggggttccgggtaacccgggaaaccgggggtaaacgttaacgggggtaacgtaaacggtaccctaaacggtttacccggtagtcgggaccgttcgaaccc

SEQ ID NO: 214940 - DNA, 754 bp, Homo sapiens
  misc_feature: GYAE6OF01ERRED.1.34.D01.1.454.CMB.1.raw
  modified_base (102)..(102): a, c, t, g, unknown or other
  misc_feature (102)..(102): n is a, c, g, or t
  modified_base (201)..(201): a, c, t, g, unknown or other
  misc_feature (201)..(201): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattcgacccagtcctccatccctccctgtctgcatctagtgganacagacgtcaccatcacgttcggccgggacgagtcgacggccatcgagcgtatttctttacgccgttagggttcgacgagaccgaaacggaaacccgaggggaccgaccgtccccctagacggtacgttacggttagttccgttaagtcgggtacgacctacgtaccgaaggtacgttacggacggtaacgggggttccgggtacccctaacggtaccggtaaggttcgtaggtacgggacgtacggtcgaccgtaaggttccggtacgggtaactaacggttaccttaacctaccctttacgttaaccaacttacgtaccgacgtaccgtacgtcccgtaggaccgtaacgtaccgttaaggtaacgttttacgttttaccgaacttttaacgttttaacgttactacgttaactaacgttacgtttaacttaaccgttaccgttaacccggttaggttaccgggtaccggttaccgggaccgggtaagggtaaccgtaagggttacgaaaccgtaaccgaaacggtacgtagggtacgtcgtcggtaaccc

SEQ ID NO: 214941 - DNA, 664 bp, Homo sapiens
  misc_feature: GYAE6OF01BWJPL.1.34.D01.1.454.CMB.1.raw
  modified_base (317)..(317): a, c, t, g, unknown or other
  misc_feature (317)..(317): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctcctgtctgcatctagttggagacagacgtcaccatctacttcggccgggcgacgtcaggccatcgagtctatttcttagcctggtcgcagacaacgaaaccgagggcgacgcccctagagtactcgtagtctagtggtanctactccgagtagttggacgtaaggggtccgggtacccctaagtccgtacggtttacagggttcgataacggttcgacgtaacgttcggttagggaactaacgtacgttacctaccgttactacgtaaccttactcgaacggtcaacggccttacggacgtacgaccgttagaagtttctttaacgtacttaaattttacttacttagtaacctaagttaagttaacgtttaacttaaccggtacccgttacggttaccgggtaccggttaccgggaccggtaaggggaaccgtacgggttaacggaaccgtacgtaaaccggtacgttacgggcgtcgtcgtaacc

SEQ ID NO: 214942 - DNA, 693 bp, Homo sapiens
  misc_feature: GYAE6OF01BRZOP.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgatttcttagcctggttgcagacagaaaccgagggcgacgcccctcagatcgtagtctagtggtgctatccagtacgttggacgtaacggggttcggggtacccagttcccgtaagggttcaagggttcggcctaggtcgtaccgtagttacggtacggggaactaacggtaacttaactacccttacctaccgtaaaccttacgtaccgaacggaccgaacgtcccgtacgaccgtacggtacccttaaggtaaacgtttagttttacgaactttaaacgttttattaaccgtagtaacctaactagtttaacttacgttaaccgtacccgttacggttacggtaccggttaccggaccggtaacggggaaccgtaaggggtacggaaaccgtaccgtaaaccgtacgtcggtacggacgtacggacctaccgtacttcgttacgttaccttacctaccttccccgttcccctaccccg

SEQ ID NO: 214943 - DNA, 660 bp, Homo sapiens
  misc_feature: GYAE6OF01BHVCV.1.34.D01.1.454.CMB.1.raw
  modified_base (196)..(196): a, c, t, g, unknown or other
  misc_feature (196)..(196): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatgganacagagtcacatcacttgccgggcgagtcaggccatcagtcgattctttagccttggttcgcagacaacgaaaccgagggcgacgcccctacgagatcgtagtctagtggtgcactcagtatgacgtaaggtcgggaccagtcgtaggtcaggtgcgtagtgactagtcgtagggacagtacttacactctactaactactacgacgtacgacgtcctgacctacgtacccgttaaggaacgtttacttttacgaactttaagttttaacttaacgttacgtaacccttaaagttacgtttaacgttaacgttaaacccggttaacccccgttaacgggttaccgggtaacccgggttaccgggtaacccgggtaacgggggttaaacccgtaaacggggtaacgggtaacggttaaacccgtaaacccggtaacgttagggtaccgtacggttcgtaaacccg

SEQ ID NO: 214944 - DNA, 816 bp, Homo sapiens
  misc_feature: GYAE6OF01DEZFC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccactcctccctgtctgcatctattggacgacagacgtccaacctatccgacgttcggacccgggacgtacgtccgacggaccacgtccgaaggtaccgttattttaccgttttacggccgtttgggtttacgaccgaacggaccgaaaccgggaaaaacccggacgggggaccgaacccggtacccccgtacgaagtacgttccggtaacggttaccgttaggttgggtcgacctaacgtacccgaagtaacgtttcgggaacggtaaacggggttccggggtacccctacgttaccccggtaagggtttacgaacgggttcgggaacgtacggttcggtacgtacggttacggttacggggaacctaaggtaactttaaccgtaccgtttacctaccgtaaccgttacgtaccgtaacgaccgtaccggtcctacggaccgtacgtaccgttaaggtaaacgtttattttacgtaactttaaattttaccgttacgttacgtaactaacttaagtttaacttacgttaacccgttaccccggttaggtaccgggtaccggttaccggaaccgggtaacgggtaacggtaacgggtacgtaaaccggtaccgtaaaccgttaacgtggtacgcgtccgaaccg

SEQ ID NO: 214945 - DNA, 639 bp, Homo sapiens
  misc_feature: GYAE6OF01BLAZZ.1.34.D01.1.454.CMB.1.raw
  modified_base (461)..(461): a, c, t, g, unknown or other
  misc_feature (461)..(461): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagagtcaccatcacgttcggccgggcgagtcaggccatcagcgtattctttagcctggttgcagacgaagaaaccgaggggccgacggccccctagacgtactcggtagttctagtgggtgcatccagattggacgaaggggttcgggtcccagtccgaggttcgaggtggcaggtgacctagtcggtagggaacaggtacttacaccttctacgacttataccagtcgacgccctagacacgtccttaggtaaagtttnttttacggaactttaattttaacttacgtagtaacgtaactagtttaacgttacgtaaccggttaccccgttaggtaccgggttaccggttccggggtaccggacgggggtaaaccggtaaggggttacggaaacgttaccgaaaccggttaacgtaggggtacggtcgtcgaacccg

SEQ ID NO: 214946 - DNA, 780 bp, Homo sapiens
  misc_feature: GYAE6OF01CD2V4.1.34.D01.1.454.CMB.1.raw
tcagacgagtgcgtcacgaccggtgctcgatttagatcgtctgtgttggggttggggagtcgagaccctggtcgaggacacagcagtaggacatcgaggtcccgctcgacgctcctgggctccctgctgtctcgtgcctccgaggtaccaggcgtcgttcgaacatccgaattcgaacccagtcctcccaacttccgtcccgtgtctcgccagtactaagtcggagacagacgtcaccatcgacgttgccggacgtagtaccaaggacctatacgtaggtcggtacttacgttacgccgtaggttcgaccgacgaccgaacgtaaaccggagggtccgtaacggcccccttacgaagtacgtaccggtaacgtcgttaacggtcgggtacgtaccgtaacggtaccctaacggtaagttacggacgtaaacgggggtttccgggtacccctagttccccgtaacggtttcgaacggttcgggacgtaacggttcgaccgtacgtaccggttagggaactagtacttacggtaccgtaccgtacgtacgttatacgaaggacctacgtcgtacgtactacgtcgtaacgaacgttactttaggaactttaaaggttttacgcgttagtacctaaggttagtttaacgttacggtaccggtaaacccggtaggttacggttacggttaccgggtaccgtaagggggtaacctacggggaaccggttaaaccggtacgtaaaccccggttaccggttagggtaccgtcgtccggtaaaccccg

SEQ ID NO: 214947 - DNA, 716 bp, Homo sapiens
  misc_feature: GYAE6OF01DE0LE.1.34.D01.1.454.CMB.1.raw
  modified_base (113)..(113): a, c, t, g, unknown or other
  misc_feature (113)..(113): n is a, c, g, or t
  modified_base (151)..(151): a, c, t, g, unknown or other
  misc_feature (151)..(151): n is a, c, g, or t
  modified_base (206)..(206): a, c, t, g, unknown or other
  misc_feature (206)..(206): n is a, c, g, or t
tcagacgagtgcgtcacgaccggtgctcgatttagatcgtctgtgttggggtttgggggagtcagaccctgtcaggacacagcatggacatgagggtccccgctcagctccgnggggctcctgctgctctggctcccaggtaccagctgtnactatccaattgacccagtctccactccctccctgtctgcctattctagttgganacagacgtcactatctacgttcggccgggcgaacgtcgaggtaccaagtccgaagtcgtacttcgtttacgtcgttggttcgacacggacgaacggaaaccgaggggtcgaaccggccctacgaacgtacgtaccgtagtaccgtagtaggtcgtactacgtaccctaaggtacgttacggacggtaacggggttaccggggttacccaaggttacccgtaggttacgtacgggttacggactacgggttacgaccgtaagtacggtacgggtacaaggtacttaccaccttacacgtaatacgtacgtaacgcctaggacctgaactacggacctagggactttatttacgtaactttatttaacgtaccttagtaactaacgtaagtttaactaccgttaaccgttaaccgtagggtaccgtacggttaccggaccggtaacgggtaaaccggaggttaccgggtaaagtacccgtaaacggtaacgtgggtaccacgtaccgtaccg

SEQ ID NO: 214948 - DNA, 770 bp, Homo sapiens
  misc_feature: GYAE6OF01EQMG8.1.34.D01.1.454.CMB.1.raw
  modified_base (102)..(102): a, c, t, g, unknown or other
  misc_feature (102)..(102): n is a, c, g, or t
  modified_base (206)..(206): a, c, t, g, unknown or other
  misc_feature (206)..(206): n is a, c, g, or t
tcagacgagtgcgtcacgaccggtgctcgatttagatcgtctgtgttgggtttgggggagtcagaccctgtcaggacacagcatggacatgacgggtccccnctcagctacgtggggctcctgctgctctggctcccaggtaccagatgtgacatccaattcgacccagtcctccacttccctccgtgtctgctatctagttgganacgagtacgtcaccatacgtaccgtttcggcccggggacgtacggtccgacgggcctaacgtcgacggtcgtaacgttttccgttttaacggtcccgtttagggtttccgacggacgtacgaaacggaaacccggacggggaccgacccggtcccccgtagaacgttacgttcggtacgttccgtagtggactacgactacgagttacgttaggacggtacggggtaccggtacctacgttcccggtaggttcgaggtccggcgtaacgttcgtaccgtagttccgggtacgggaacgttaacttaacgtttaccctaccgtttacctaccgtaacgtttacaaccgacggtaccaacgttccgacggacctacgccttaaggtacgttttattttaccggaattttaacctttagtaacgttacgtaactacgttaatttagtacccgttacgttaacccgttgggttaccgggtaccgttaccgggaccggttaacggggaacgtacggggtaacgtaaaccggtacctaaacgggttatcgggtaccgtgttacccgaccg

SEQ ID NO: 214949 - DNA, 608 bp, Homo sapiens
  misc_feature: GYAE6OF01API1E.1.34.D01.1.454.CMB.1.raw
  modified_base (286)..(286): a, c, t, g, unknown or other
  misc_feature (286)..(286): n is a, c, g, or t
  modified_base (600)..(600): a, c, t, g, unknown or other
  misc_feature (600)..(600): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctgggttgcagcaagaaaccgaggggcacgcccctnagatcgtagtctagtggtgacatccaggtattggacgtaaggggtcgggtaccccagtcccgtaaggttcaggttcgggcgtgtcagtcgtagggtacgagtattactactacgtcactatcagcgacgcgtcgtcacgactacgtaagtagtttcgtacttaattttaactttacttacgtaacgaacgttagttaaatttacgttaacgttaccccgtacggttacgggttaccggttaccggtaccgggtaacggggacggtaacggtacgggtaagtaacccgtaaccgtaacggtcggttaggcggtcncgtaaccg

SEQ ID NO: 214950 - DNA, 904 bp, Homo sapiens
  misc_feature: GYAE6OF01EJFKC.1.34.D01.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctagtgganacagactcaccatcacgttcggccgggnagtcgacggccatccgagcgtatttcgtttagccgttggttcacgacgacgaaacgaaacccggaggggaccggtaaccgcccctacgagtacgttacggttagttacctaggtcgggtacacctaacgttaccgaaggttacgttacgggtaccggtaaacggggggttcccgggtacccctaacgttacccgggtaacgggtttacgaacggggttcggtaccgtaagggttccggaaccgttaaggttacccgggtacggggtaaacgttaacggttaaccttttaaacccgtaccctttaaccgtaaccgtaaacctttaacgtaccgtaaacgggtcccgtaaccggtcccgtaacggtacccgtaaccggtaccgttaaaggttaacggttttaacgttttacgtaaactttttaaacgttttaacgtttaacccgttaacgttaaaccgtaaacgtttaacgtttaaccgttttaaacccgttaaccccgggtttaaacccccggtttacgggtttaccggggttaaaccccgggttaacccgggggtaacccggggtaaaaccgggggtaaacccgggttaacggggttaaacgggtaaaaccccggttaaacccggtaaaacccgggtttaccggttagggtaaccgggtacccgtaacggtaaccccg

SEQ ID NO: 214951 - DNA, 738 bp, Homo sapiens
  misc_feature: GYAE6OF01BSA9Z.1.34.D01.1.454.CMB.1.raw
tcagacgagtgcgtcacgaccggtgctcgatttagatcgtctgtgttgggtttgggggagtcagaccctgtcaggacacagcatggacatgaggtccccgctcagctcctggggctcctgctgctctggctcccaggtaccagctgtgacatccaattgacccagtctccatccctccctgtctgcatctagttggagacgagagtccacctatcacgttcggcccgggcgacgtcgacggccatccgacgcgtactttctttagccttggttcgctagacaacggaaaccgaggggaccgacgcccccgtacgacggtacgtccgtagtcgtagtcgggtacactactaccgagtacttcgacgtaagggtcgggtaccctacgttccgaagggttccaacgggttcgggaactaggtagcgtacgttacggtacggggaactaacggttaacttaacccgtaccttaccttaccgtaaacctttaacgtaccgaacggtacccaccggtccccgttacggacccgaacggttacccgttaaggtaaacggttttaccttttaggtaacctttaaacgtttttatttaaccgtacgttactaaacgttaagttaactttaacgttacccgttaaccccgtaggttaccgggttaccggttccggaaccggtaaggggaaccgttaaagggaccggtaaactaccggtaaaccgtacggtgtacgtccgtcgaacccg

SEQ ID NO: 214952 - DNA, 632 bp, Homo sapiens
  misc_feature: GYAE6OF01DMBQI.1.34.D01.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattgacccagtctccatccctccctgtctgcatctatgganacagagtcaccatcacttggccgggngacgtcaggccatcagtcgtatttcttagccgttggttgcagacaagaaaccgaggggccgacgcccctacgagtactcgtagtctagttggtgacatccagtagttcgacgaacggggttcgggaccccagtacccgtaaggttccgaggtggacgtagtgctagtggtagggactagtacttacnctcctanactaagtcagtcacgtccctgaccgtgtacctaggtaagtttcgtttagaactttaagttttacttacgtagttaaccaaagttagttaactttaacctaaccggttacccccgttagggtacggttacccggttacgggaccggaacggggttaaccgtaagggttacggaaacgtacccgtaaaacgttacgtgggtacggccttggaaccc

SEQ ID NO: 214953 - DNA, 570 bp, Homo sapiens
  misc_feature: GYAE6OF01BZGGM.1.34.D01.1.454.CMB.1.raw
  modified_base (209)..(209): a, c, t, g, unknown or other
  misc_feature (209)..(209): n is a, c, g, or t
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
  modified_base (563)..(563): a, c, t, g, unknown or other
  misc_feature (563)..(563): n is a, c, g, or t
tcagacgagtgcgtcacgaccggtgctcgatttagatcgtctgtgttgggtttgggggacgtcagaccctgtctaggacgacagcagtggacatggagggtccccgctcagctccgtggggctcctgctgctcctaggctcccaggtaccagctagtgacatccaattcgacccagtctccatccgtaccctgtctgcatctattgganacgagagtcaccatcactgccggcgagtcgacggccatcacgcgtacttcctttagccttggttgcaggacctaaggaaccgagggcaacgcccctgacgtagtcgtagtctagtggtacgctacttccagtacttcgcgtaaggggtcgggtacccagtccgaggttcaaggtcggacgtagtcgactatcgtagggacagtactacgactcgtacacttancgacgcacgctagcacgtctagagttntttacgattaacttttgtacgtcgtaacctagtattatacctacgtacccgtaggtcggtacgttcggacgtagggacagggtcgaataccgacgacgtgcgtnggtaacc

SEQ ID NO: 214954 - DNA, 861 bp, Homo sapiens
  misc_feature: GYAE6OF01ELT7H.1.34.D01.1.454.CMB.1.raw
  modified_base (104)..(104): a, c, t, g, unknown or other
  misc_feature (104)..(104): n is a, c, g, or t
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatggagggtcccccgntcagctccgtggggctcctgctgctctggcctcccaggtaccagctgtgacataccaattcgacccagtcctccactccctccctgtctgctatcttattcggagacagagtccaccatctacgttgcccgggtcgacgtcgacggccatcgagtcgtatttcgtttagtccctggttcgaccgagacaacggaaaacccggnggggaccgacccgcccctagacggtaacgttaccggttaggttactaggtcgggttcgcctacttacccgaaggtacgtttaggacggtaacggggtccgggtacccctacgtaccccgtagggttactagggtcggacgtacggtacgccgtaggttccggttacggggaactaacggttaactttaaccaccgtttaccgtaccgtaacttactaccgaacgtaccgtaacggtcccgtacgtaccgacggtaccccgttaaggtaaactttttacggttttaactaacttttaaagtttttaacgtttaaccgtttaacgtaaccgttaaaccgtttaaagtttaaaccgtttaaccgttaaccccgggtttaaccccggtttaaccggggtttacgggggttaaacccccggtttaccggggggtaaccccggttaaacccgggggggggtaacccggtaaaaacgggggtttacccgggaaaacgggttaaacccccggtaaacccggttaaacgggttacggttaccgggtcggtaccgtaaaccccg

SEQ ID NO: 214955 - DNA, 747 bp, Homo sapiens
  misc_feature: GYAE6OF01B7287.1.34.D01.1.454.CMB.1.raw
  modified_base (587)..(587): a, c, t, g, unknown or other
  misc_feature (587)..(587): n is a, c, g, or t
  modified_base (739)..(739): a, c, t, g, unknown or other
  misc_feature (739)..(739): n is a, c, g, or t
tcagacgagtgcgtcacgaccggtgctcgatttagatcgtctgtggttggggtttgggggagtcagaccctgtcaggacacagcatggacatggacgggtccccgctcagcctccgtggggctcctgctgctctggcctcccgaggtaccagctgtgacactaccaattcgacccatcctccactccctccctgtcctgctaactcgttaagtagggaacgacgaggtacgtaccaacctataccgtacgttggacggtcgggacgtacgtacgacggacctaatcgaaacgtcgttaactttcggttacgtccggttggtacacgacgaaccgaaagggtaaaccgacggggaccgaccgacccctagaacggtacgttaccgtaagttcgattcgggacaccgtattaccgagtaagtcggaacggtaacgggtccggtaccagtaccgtaaggtcagggtcgcgtaagtccgacgtactaccgggaaagggtactaacgtaacttacctacctacgttaccaacttaacgtaacgacgtacgacgtccgtaagccgtaacgtcgtaaagttacgtacgttttanaactttaattacgttaacctagtaaaccgtaacgttaacgttaacgttaaccgtaacccggtacccgttaagggtacccgacgggttaccggaacgggaacgggttaccgaaagggttacccgaaacgtaccgtaaaccggagttacgtggngtaacccg

SEQ ID NO: 214956 - DNA, 585 bp, Homo sapiens
  misc_feature: GYAE6OF01AXYDF.1.34.D01.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (360)..(360): a, c, t, g, unknown or other
  misc_feature (360)..(360): n is a, c, g, or t
tcagacgagtgcgtcacgaccggtgctcgatttagatcgtctgtgttgggtttgggggagtcagaccctttcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttncagcagaaaccngggcgacgcccctgagatcgtagtctatggtncatccagnttggacgaagggtcggggtcccatccgtaggttcaggtggcagtgcagtcgngggacagtacttacactcactactactcacgcacgtcctgaccagccctagtaagttgttttacgacctttaattttacttaccgtagttacctaactagtttaacttaagtaacccgttaccccgtacggtcggtaccggttaccgggacccgaacgggggtaacccgaagggttacggaaacgtaccgaaaccggtaactcggtaggtcctcggcctaacccg

SEQ ID NO: 214957 - DNA, 574 bp, Homo sapiens
  misc_feature: GYAE6OF01BSUKM.1.34.D01.1.454.CMB.1.raw
  modified_base (259)..(259): a, c, t, g, unknown or other
  misc_feature (259)..(259): n is a, c, g, or t
  modified_base (372)..(372): a, c, t, g, unknown or other
  misc_feature (372)..(372): n is a, c, g, or t
  modified_base (527)..(527): a, c, t, g, unknown or other
  misc_feature (527)..(527): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggccgacgcccctnagtatacgtagtctagtggtgcattccagtattggacgaagggtcgggtcccagtcccgaggttcagtcggacaggtgacatcgtaggacagtacttacacttctactaactntacgacgcagcctaggccaggtcccttaggaaacgttattttagacttaattttattaactgtacaactagttacttacgtacgtacccgtaggtacggtaccgttccggacgacggggactaggtaggaacgtaccgaaacgacgtgtcggtancggtccacgtattcgtacgttcttacctcgttcccgttcccgtcccc

SEQ ID NO: 214958 - DNA, 578 bp, Homo sapiens
  misc_feature: GYAE6OF01A4WRH.1.34.D01.1.454.CMB.1.raw
  modified_base (573)..(573): a, c, t, g, unknown or other
  misc_feature (573)..(573): n is a, c, g, or t
  modified_base (575)..(578): a, c, t, g, unknown or other
  misc_feature (575)..(578): n is a, c, g, or t
tcagacgagtgcgtcacgaccggtgctcgatttagatcgtctgtgttgggtttgggggaggcttgataaagcctggggggtccctgagactctcctgtggagcctctggattcaccttttggaacctacgccatgagctgggtccgccaggctccagggaaggggctggagtgggtctccgctattagtggtagtggcggtagcacatactacgcagactccgtgaagggccggttcaccatctcccgagacaattcgcagaactacgttgtttttgcaaatggacagcctgagagtcgcggacacggccgtctatttattgtgcgacgcgcttattataatataggctagtggggccacgggaaccctggtcaccgtctcctcacgcctccaccacggcccagtccggtaccttcccctggccgccctcgcctccgaggacgccaccgtccgagacgcacgacgccggccgtgggcctcggcctgggtaccaacggtaccttacttcccgacgtcccacgtcctacgtcggaggccgggtcgttgggaccgaaagggccgacgaacgtacgnannnn

SEQ ID NO: 214959 - DNA, 466 bp, Homo sapiens
  misc_feature: GYAE6OF01ALFQX.1.34.D01.1.454.CMB.1.raw
  modified_base (433)..(433): a, c, t, g, unknown or other
  misc_feature (433)..(433): n is a, c, g, or t
  modified_base (436)..(438): a, c, t, g, unknown or other
  misc_feature (436)..(438): n is a, c, g, or t
  modified_base (440)..(466): a, c, t, g, unknown or other
  misc_feature (440)..(466): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgactaattttattactgtacaactagttattatacgtaccccctaggtggtaccgttcggaccagggggaccaagggtggaagtccaaaccggtaactggtggactgaccacccagttctcgttaccttctactccttcccgcctatctacgaactcactccgtctggacggcgggtctggacaagggccgacagtagctncannncnnnnnnnnnnnnnnnnnnnnnnnnnnn

SEQ ID NO: 214960 - DNA, 731 bp, Homo sapiens
  misc_feature: GYAE6OF01DA7V9.1.34.D01.1.454.CMB.1.raw
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattcgacccagtctccatcctccctgtctgcatctatggagacagagtccaaccatccacgttcggccgggcgagtcaggccatcagcgtattcttagcctggtncagcaagaaaccgnggccgacgcccctanagactcgtagtctagtggcactataccagtagttcggacggtaaagggtccgggtaccccagttcccgtaagggtttccaagggttcggaccgtaagggtcgtaacccgtaggttaccggttaggggaaactaggttaaactttaacccaccgttacctacgtaacttaacgtcgaacggtccacggtcccttaggacccgtaacggtacccgttaaggtaaacgtttacgttttttacggaacttttaaaagttttttactaaccgtttacgttaacctaaaccgttaaggtttaactttacctaacccggtttaaaccccgttacggggtacggttaacccgggtttaccgggaacccggtaaacgggggtaaccgtaagggtaaaccggtaacgtacccggtaaacggtaacgttgggtacggtccgtggtaaacccg

SEQ ID NO: 214961 - DNA, 665 bp, Homo sapiens
  misc_feature: GYAE6OF01D5BU3.1.34.D01.1.454.CMB.1.raw
  modified_base (165)..(165): a, c, t, g, unknown or other
  misc_feature (165)..(165): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccngtctccatcctccctgtctgcatctattggagacagagtcaccatcacttgccgggcagtcaggccatcagcgtattcttagcctggttgcagacaacgaaaccgngggccgacgcccctanaggtactcggtagtactagtggtcgacactccgagtagttcggacgtaaacggggttcgggtaccctagttcccgaaggtttcagggttggacctaggtcgacgtacgtcggtaggggaactaaggtactttaaccacttaccgtctaacttacgtcaaggactaccgtccgttacgacccgtaagtcccgtaagggtaaacgtttagttttacgaactttaaatttttacgtaaccttggttaaccttaaacgtattttaacgttacttaaccccggttaacccttggggtaaccggtaccggttaccggggacgtaaaggggaccgtaaagggtacgtaacgtaaccgaacgttaacgtggttcgccgtaagtccc

SEQ ID NO: 214962 - DNA, 833 bp, Homo sapiens
  misc_feature: GYAE6OF01DJ620.1.34.D01.1.454.CMB.1.raw
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctcgtcggctcccaggtaccagctgtgacactaccaattcgacctaggggtctccactcctcctcgtctgctacttctagttggagacgagacgtcacctactctacgttcggcgggacgtagtcgacggccatcgacgctattcgttagccgttggtcgacaggacaacggaaaccgnggggaccgacgcccctagacgtatacgtagtcgtagtcgggtactctactccgtagtacgttcggacggtaacggggtccgggtacctacgttacccggtaggttaccgtacggtcggtacgtaggttacgacggtagtacgggtacggggtaactaacgggttacttaacctaccttacggtactaaccggttatacccgtaacggtacccgtaacggtttccccgaaggccggttaaacccggtacccgttttaacgggttaaaggtttacttttaaccgggtaacctttttaacgtttaacgttaacccgttacgtaacttaaacgtttagggttttaaccttaacggttaaccccggtttaaacccgtacgggggtaccgggtttaaacccggggtacccggggtacccgggtaaacgggggggaaaccctttacgggggtaaaccgggttaaacccgttaaccccggggttaaaccgtaacgggtttaccggggcgggttaacccggtacttaacccccggg

SEQ ID NO: 214963 - DNA, 632 bp, Homo sapiens
  misc_feature: GYAE6OF01A4DU2.1.34.D01.1.454.CMB.1.raw
  modified_base (312)..(312): a, c, t, g, unknown or other
  misc_feature (312)..(312): n is a, c, g, or t
  modified_base (622)..(622): a, c, t, g, unknown or other
  misc_feature (622)..(622): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
tcagacgagtgcgtcacgaccggtgctcgatttagatcgtctgtgttgggtttgggggaggcttgataaagcctggggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccggttcaccatctcccgagacaattcgcagaacacgtttgtttttgcaaatggacagcctgagagtcgcggacacggccgtntattattgtgcgacgcgctattataatataggctacgtggggccacgggaaccctggtccaccgtcctcctcacgccctccaccgaacgggccccagtcccgtccttcccccgtggcccgccctcgcctcccgaggaccgccacccgtccggacgacgaccaccgacggcccggccccgtggggcctcggcccgttcggggtaccgaacgggtacccttaccgttacccgaccggccctaaccgttccgtccgtcgggacgggtcccgggtcgtaggggaccgtaaccgggccgaccgtaacgttacggntancgngncg

SEQ ID NO: 214964 - DNA, 809 bp, Homo sapiens
  misc_feature: GYAE6OF01B91E6.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtgggctcctgctgctcgtcggctcccgaggtaccagctgtgacactaccaattcgacccagtcctccactccctcctgtctgactatcgtatggacgacagagtccacatcacgttcggccgggacgagtcgacggacctatcgagtacgtactttacgtttacgtccgttggttcgacaacgaccgaaaacggaaaccggagggaccgaaccgcccctagaacggtacgtacggttacgtacgttacggtggtacaccgacgtaccgtaagtacgttacgacggtaaacggggttccgggtaacccctaggtaccgtagggttacacggtacggtacgtacggtcgtacgtagtaccggtaggaacgtaagtaacttacctaaccggtttacctaaccgttaacttaaccgacgaaccggaccgttaaccggcctacgaccgtacgtaccggtaagttaacgttacgttttaactacgttttaaatttaccgttaaccgttaacgttaaaccgtaaacgtttaacgttttaacctaaccggtttaacccccggttaaccggtttaccgggttacgttaacccggggttaccgggaaacccgggtaaagggaaacccgggttaaacggggtacggttaaaaccggaaccgttaaaaccggttaacggtcgggttaaacggacgttaacggtaacccg

SEQ ID NO: 214965 - DNA, 758 bp, Homo sapiens
  misc_feature: GYAE6OF01BCLZ8.1.34.D01.1.454.CMB.1.raw
  modified_base (174)..(174): a, c, t, g, unknown or other
  misc_feature (174)..(174): n is a, c, g, or t
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagacgagtgcgtcacgaccggtgctcgatttagatcgtctgtgttgggtttgggggagtcagaccctgtcaggacacagcatggacatgagggtccccgctccagctccgtggggcctcctgctgctctggctcccaggtaccagctgtgacatccaattcgacccagtccnccatccctccctgtctgcatctattgganacagatcaccatccacttcggccggggcgagtcgaggcccatcgagcgtatttcttacgcctggttgcagcagaaccgnggcgacgcccctnagctcgtagtctagtggtcncacgtaccagtattgacgtaagggtcgggtcccacgttccgtaagggtttcgaacggtggacgtaggtcgtacgtaaacgtcggtacggggactaacggtaacttaaccgtaccttaccgttacctaactttaacgtaccgaaggtcccaaccggttccctacggcccgtaacggtccccggtttaaggtaaacggttttacgttttaacggtaacctttaagtttttaaccctttaaccggttaacggttaaaccttaaacccggtttaagtttaacccttttaacggttaacccccgttaaaccccgggtttaacgggtacgggttaacccgggttacccggtaccgggtaaccggggtaaaccgaacggggttaacccgggtaaacgtaccccggtaaacccggtaacgttcgggttaaccgggccgttcggtaaacccg

SEQ ID NO: 214966 - DNA, 602 bp, Homo sapiens
  misc_feature: GYAE6OF01ELWFD.1.34.D01.1.454.CMB.1.raw
  modified_base (198)..(198): a, c, t, g, unknown or other
  misc_feature (198)..(198): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctatgganacagatcaccatcacttgccgggcgagtgagccatcagcgtattcttagcctggttgcagcaagaaaccgngggcgacgcccctgagatcgtagtctagtggtncactccgagtattgacgaagggtcggtacccagtccgtaggttcgaggtcggactagtcgctagtcggtaggacagtacttaccgacttctactaacttactacgagtcacgtcctgacctacggtacctagtaagttattttcaactttaattttaacttacgtcgtaactaacgttagttaacttaacgtaccgtaacccgttaggtccggtaaccggttccggaccggtaaggggtaaccgtaacgggtacggtaaacgtaccgtaaccggtaagtcggtacggtccgtcgtaaccg

SEQ ID NO: 214967 - DNA, 621 bp, Homo sapiens
  misc_feature: GYAE6OF01ELJTF.1.34.D01.1.454.CMB.1.raw
  modified_base (102)..(102): a, c, t, g, unknown or other
  misc_feature (102)..(102): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (609)..(609): a, c, t, g, unknown or other
  misc_feature (609)..(609): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttgccggcagtcaggccatcagcgattcttagcccgtggttcgcagccaagaaaccgaggggccgaagcccccttgaggtataccggtagtccgtaagtcggtgcacttccagtaatttggacgtaaaggggtcggggtaccccagtaccagggttccaaggttggccaagttcggctaacgtgttagggactagtaattactactctactacttaacncgtanccgtaaggcccttggacacggtacctaggaaattacgttttaggacttaaagttttacctacgttcgtacctaaatacggtttacttataaccggttacccctaaggttcggtacgtttacgggccgtagggggaacctaagggaggtaacgaccggtaaacgtacttaggngtccgtgacccg

SEQ ID NO: 214968 - DNA, 784 bp, Homo sapiens
  misc_feature: GYAE6OF01CZ3YU.1.34.D01.1.454.CMB.1.raw
  modified_base (103)..(103): a, c, t, g, unknown or other
  misc_feature (103)..(103): n is a, c, g, or t
  modified_base (205)..(205): a, c, t, g, unknown or other
  misc_feature (205)..(205): n is a, c, g, or t
tcagacgagtgcgtcacgaccggtgctcgatttagatcgtctgtgttgggtttgggggagtcagaccctgtcaggacacagcatggacatgacgggtccccgntcagctccgtggggctcctgctgctctggctcccaggtaccagctgtcgacatccaattcgaccctagtcctccactccctcctgtctgcattctagtgganacagactaccacctatctacgttcgggaccgggtcagtccgaggcctatcgagtcgttactttaccgttacgccgttggtacacgaacgaccgaaacgaaaccggacgggccgaccgtacccccgtagaacgtacttacggtacgtcgttaggtcggtacactactaccgtagtacttcgggacggtaacggggttccggtaccctacgttaccggtacggttaccggtaaggtcgggtaactaacgggtcgtacgtaacggttcgggtaacgggaccgttaagttaccgttaacctaccgtttacctacgtaacgttacaccggtaacgtaccgtaccggaccgttacgaccgtaaccggttacgtaaggtttaacgtttacgttttaccgtaaacttttacgttttaacgtaccgttaacggttaacaaacgtttaggtttaacttaaccggtaccccgtttaacggtaccggttaccgggttaccggtacccgggaaccgggtacgggtaaacggttacggtaaccgggtaaacgtacccggtaaaccggtcgttcgggacgtcgtaacggtaccc

SEQ ID NO: 214969 - DNA, 600 bp, Homo sapiens
  misc_feature: GYAE6OF01CSDZD.1.34.D01.1.454.CMB.1.raw
  modified_base (134)..(134): a, c, t, g, unknown or other
  misc_feature (134)..(134): n is a, c, g, or t
  modified_base (555)..(556): a, c, t, g, unknown or other
  misc_feature (555)..(556): n is a, c, g, or t
  modified_base (561)..(561): a, c, t, g, unknown or other
  misc_feature (561)..(561): n is a, c, g, or t
  modified_base (565)..(565): a, c, t, g, unknown or other
  misc_feature (565)..(565): n is a, c, g, or t
  modified_base (570)..(600): a, c, t, g, unknown or other
  misc_feature (570)..(600): n is a, c, g, or t
tcagacgagtgcgtcacgaccggtgctcgatttagatcgtctgtgttgggtttgggagtcaggccatcagcgattctttagcctggttgcagcagaaaccgagggcgacgcccctcagatcgtagtctatggtncatccagtattgcgaagggtcgggtcccatccaggttcagtggcagtgcatcgtgggacagtattacactctacactatcagacacgtcctgacacgtcctaaggaagttattttcgaactttaaattttacgttaccgtagtaactaaacgttaagtttactttaacgttaaccggttaacccccgttagggttacgggtaacccggtttaccgggacccggtaaaaggggggtacccgtaaagggttccggaaaacgttacccgaaaacccggttaagttcgggtacgggtaccttcggaacccctaacttacgttccgtcgtttaccttccacgtttccccgtacccgctacgttcgtacgaacgtccctacgtcgttacgagaccgggcgtcgacggccgaaggtccagtaatcggnntaggnagcnggtcnnnnnnnnnnnnnnnnnnnnnnnnnnnnnnn

SEQ ID NO: 214970 - DNA, 671 bp, Homo sapiens
  misc_feature: GYAE6OF01BN52C.1.34.D01.1.454.CMB.1.raw
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatccctccctgtctgcatctatggagacagactcacatcacgttgccgggagacgtcgaggccatcgagcgtatttcgttagccgtggttgcagcaacgaaccgngggccgacgcccctagacgtatcgtagtactagtggtcncataccgagtagtcgacgtacgggtcggacctacgtcgtaggtcgaggtgcgagtcgctacgtcgaggactagtactacncgtctactatacgtcgagacgacgtcctagactacgtaccgtaaggtaagtttactttagtaactttaaagttttaaccttaccgttacgttaaaccgttaacgttaagttttaacttaccgttaacccggttaaacccgttccggggttaaccgggttaaccgggttacccgggtaaccgggtaaccggggggtaaccgttaaacggggtaccggtaaacggttaacccggtaaacccggtaaggttcgggtacgtaccgtccgtaaacccgg

SEQ ID NO: 214971 - DNA, 696 bp, Homo sapiens
  misc_feature: GYAE6OF01AUUAZ.1.34.D01.1.454.CMB.1.raw
  modified_base (191)..(191): a, c, t, g, unknown or other
  misc_feature (191)..(191): n is a, c, g, or t
  modified_base (244)..(244): a, c, t, g, unknown or other
  misc_feature (244)..(244): n is a, c, g, or t
  modified_base (259)..(259): a, c, t, g, unknown or other
  misc_feature (259)..(259): n is a, c, g, or t
  modified_base (352)..(352): a, c, t, g, unknown or other
  misc_feature (352)..(352): n is a, c, g, or t
tcagacgagtgcgtcacgaccggtgctcgatttagatcgtctgtgttgggtttggtcatggacatgagggtcccgctcagctcctgggctcctgctgctctggctcccaggtaccagctgtgacatccaattgacccagtctccatcctccctgtctgcatctatggagacagagtcacatcactgccggnagtcaggccatcagctatttcttacgccttggttcgcagacaacgaaaaccgnggggacacgccctanagtaactcgtaagtctagtcggtgacactccgagtattcggacgtaaggggtccgggtccctaagtcccgtagggttcagggtcggcacggtnctaacgttcggtaggaactaagtaactttacgacttcctacgtaacttacgacaacgtacgaacggtccctacggccgtacggtaccttaaggtaacgttacttttacgaacttttaatttacgttacgtacgttaaccaaacggttatttaactttaaccgttaaccggttaccccgttaagggttacccgggtaacgtttacccgggaaccgtaacggggggaacccttaaagggggtcgaaacgttacccggtaaaccgtaacgggttcggtacggccggtaactacccgacgttaaccgtgttaacccgttcttacctaccgttcccgttaccccggtac

SEQ ID NO: 214972 - DNA, 689 bp, Homo sapiens
  misc_feature: GYAE6OF01EQ3OK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctagttggagacagagtcaccatcacttgccgggcgagtcgaggccatcagcgtattctttagccgtggttgcagcaagaaaccgagggcgacgcccctacgagtacgtcgtagtctagtggtgcactccagtagttggacgagggtcgggtcccagtccgtacggttcgaggtcggacgtagtcgctagtcgtagggtacagtacttaccgaccttcctactaacgtactacgacgacgtaaccgtcccgtgacccgtacggtaccgttaaggtaaacgttttacttttacggaaccttttaaacgtttttaacgttaaccgttaggttaaccctaaacgttaacgtttatttaaccgtaaccgttaccccgttaagggttaccggtaacccggtttacgggacccgggttaagggggaaacccgttaaggggtaaccggtaaaccgttacccggtaaaccggttaaacgttcgggttacggtccctacggtaaccccg

SEQ ID NO: 214973 - DNA, 863 bp, Homo sapiens
  misc_feature: GYAE6OF01ACIB4.1.34.D01.1.454.CMB.1.raw
  modified_base (101)..(101): a, c, t, g, unknown or other
  misc_feature (101)..(101): n is a, c, g, or t
tcagacgagtgcgtcacgaccggtgctcgatttagatcgtctgtgttgggtttgggggagtcagaccctgtcaggacacagcatggacatgaggtccccgntcagctcgtgggctcctgctgctcgtggcctacccgaggtaccagtctgtgacactaccaattcgaccctagtcctccactccctccctgtctgctattcgtagtggagacagacgtccaacctatccgtacgttcggacccgggtcgtaggtccgacggtacctaagtccgaaggtaccgttacgtttaccgttttacggcccgtttggttacgccgtaacggtaccgaaaccggaaaacccggtacggggaccccgtacccggtacccccgtagaacggtaccgtttaccggttacgttacggttaagttcgggtctaacgtacgtaaccgtaggtacgtacggacgggtacgggttcccgggtaaccctagtcccggtaaggttcgtaaggtcggacgtaggtacgtacgtcgttcgggtacggtaactaaggttaccttaacctaccgttaccgtacgtaacgttaccgtacgtaccggacgtaaccgtccgtacggaccgtacgtaccggttaagttacgttttaacgtttaccgtaactttttaatttaacccgtacgttaaccgttaacgttaaaccgtttaacgtttacccgttaaaccgttaaccccgggttaaccggttacggttaacccggggttacccgggttaaccggaaccccggggtaaaggggtaaaccggtaacgggttaaccggaaaccgttaacccggtaaaccgggttaacgtccgggtacgttcccgtaacggtaaccccg

SEQ ID NO: 214974 - DNA, 651 bp, Homo sapiens
  misc_feature: GYAE6OF01CVAUP.1.34.D01.1.454.CMB.1.raw
  modified_base (214)..(214): a, c, t, g, unknown or other
  misc_feature (214)..(214): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (374)..(374): a, c, t, g, unknown or other
  misc_feature (374)..(374): n is a, c, g, or t
  modified_base (433)..(433): a, c, t, g, unknown or other
  misc_feature (433)..(433): n is a, c, g, or t
tcagacgagtgcgtcacgaccggtgctcgatttagatcgtctgtgttgggtttgggggagtcagaccctgtcaggacacagcatggacatggacgggtcccccgctcagctccgtggggcctcctgctgctctggcctccccgaggtaccagctgtgacatccaattcgacccagtcctcctatccctccctgtctgctatacttagttggaanacagaacgtcaacctatccacgttcggccgggacagtcgacggcatcgagcgtacttcttacgccgttggtgacaacgcaaacggaaaccgngggaccgacgccccctagagatccggtatctagtggnacatacagtatgacgagggtcggaccatcgngttacaggtgactagcgatagtcgtagggacagtacttaacgccttacgtacaacttancgaagcctacggtcctacgacgaaccgtaccttaagtaacggtttattttacggacttttaaaagtttaccttacgtacgtaacgtaactaagtttaacttacgttaacccggtaaccccgttggtacggtaccggttccggaacgggaacggtaacggtaaagggtaaccgtagaacccggaacggttaagtccgggtagtccgtaccgtaaacccg

SEQ ID NO: 214975 - DNA, 708 bp, Homo sapiens
  misc_feature: GYAE6OF01D1NS0.1.34.D01.1.454.CMB.1.raw
  modified_base (193)..(193): a, c, t, g, unknown or other
  misc_feature (193)..(193): n is a, c, g, or t
  modified_base (301)..(301): a, c, t, g, unknown or other
  misc_feature (301)..(301): n is a, c, g, or t
  modified_base (449)..(449): a, c, t, g, unknown or other
  misc_feature (449)..(449): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctcgtggctcccaggtaccagctgtgacactaccaattcgacccagtcctccactccctccctgtcngcatctattggagacagataccacatcacgttcggccggcgacgtcgaggcctatcgagtcgtatttcgttacgtccgttggttcgcacgaccgaacgaaaacccggngggaccgaccgcccccgttagaacgtacgttccggtaagtccgttaggtcggtagcctacgtcgtaagtagtacggacggtaacggggtcggtacctacgtacggtaggttcgaggtcggtacgaggtcacgtagttcgacggttaanacgttaacgtacccacgttactaccgtactaacgtccgagacctacggccctaggcctacgacgttaagtacgtttaacttacggtaactttaagtttacctacgtacgtaacctaaagtttacgttaaccttacgttaaccccggtaccgtacgtaccgggtacccgttaaccgggccggtaaaccgggtacgtaaaaccgggtggtaaaacccgtaccctaaccggtacttagggtaccggcgttaacgtaaccccg

SEQ ID NO: 214976 - DNA, 835 bp, Homo sapiens
  misc_feature: GYAE6OF01DOXP5.1.34.D01.1.454.CMB.1.raw
  modified_base (161)..(161): a, c, t, g, unknown or other
  misc_feature (161)..(161): n is a, c, g, or t
  modified_base (218)..(218): a, c, t, g, unknown or other
  misc_feature (218)..(218): n is a, c, g, or t
tcagacgagtgcgtcacgaccggtgctcgatttagatcgtctgtgttggggtttgggggagtcagaccctgtcaggacacagcatggacatggacgggtcccccgctcagcctccgtggggcctcctgctgctcgtcggcctcccgaggtaccagctggtnacactacctaattcgacccagtcctccacttccctcctgtctgctatctaggtgganacagactacacatcgtacgtcggaccgggcgacgtccgacggcctagtacgagtccgttatttccgttacggtccgttaggttcgacgaacggaaccgaacgggaaaccggcggggacctacccgccccgtagagttacgtcgtaaggtctaggttcggacactacgtcgtaagtggttacggaacgggttaccggggtaccggtacccctagttacccggtaggttaccgaggtacggtaacgcgggtacaaccggttcgtaccgggtaacgggtaacttacggttaacctaaccgtcttacctaccgtaactacgacgacgtaccacggtaccgtcgtaaccggtacgtaaccgttaagtaacggtttttacgttaacttaactttaacgttttaaacgttctaacccgttaaacgtttaaaacgttcggtttaaacctttaaaccccgggttaaccgtttaacccccgggtaaggggtttacccggggaaacccgggttttaccccggggaaaccggggttaacggggtaaaacccggttaacggggtaaacccggttaaaccggaaacggttacccgggtacgttaacggggccttaccgaccggttaacccg

SEQ ID NO: 214977 - DNA, 666 bp, Homo sapiens
  misc_feature: GYAE6OF01A8CY1.1.34.D01.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcgagaccctgtcaggacacagcatggacatgagggtccccnctcagctcctgggctcctgctgctctggctcccaggtaccagctgtgacatccaattcgacccagtcctccatcctccctgtctgcatctatggancagatccaccatcacttggccggngagtcaggccatcagctattctttagccttggttcncagcaagaaccgagggccacgcccctnagtatccggtagtctagtcggtacgactacgtccgaagtcgttagaccgtaaggggtccgggtaccaacgtccgtaagtctaggtgcctagtgactagtcgtagggacctaaggtacctttacgtaccttactacgtaactttagacctaagacctacgttaccgtgaacctacggtccgtttaagaaacggttttcttttaccgaacgtttaaacttttaacgttaccgtacgtttaacaagtttaaaggttaccttaacgttaacccggttaacccgtagggttacgggtaaccggttccggacgtaacggggtaccctaaaggggttccgaaacgtttcccgaaaaccggttacttacgggtacgtcgtaccggaacc

SEQ ID NO: 214978 - DNA, 459 bp, Homo sapiens
  misc_feature: GYAE6OF01BFDW2.1.34.D01.1.454.CMB.1.raw
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (420)..(459): a, c, t, g, unknown or other
  misc_feature (420)..(459): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggaagtgcatctgggacagattacactctcactatcagcagcctgcagcctgaatattttgactaatttattactgtacaactagttattataagtaccctagtggacgttcggccaggggaccaaggtggaagtcaaccgaatgtgactgcactatctgtctcgacttctacccaccctcctcaccgcaccgttctctaggacgaccgggtcctgggaccgtaaacggccgataaacgtggcncgancnnnnnnnnnnnnnnnnnnnnnnnnnnnnnnnnnnnnnnnn

SEQ ID NO: 214979 - DNA, 588 bp, Homo sapiens
  misc_feature: GYAE6OF01B1JA7.1.34.D01.1.454.CMB.1.raw
  modified_base (146)..(146): a, c, t, g, unknown or other
  misc_feature (146)..(146): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (416)..(416): a, c, t, g, unknown or other
  misc_feature (416)..(416): n is a, c, g, or t
  modified_base (451)..(451): a, c, t, g, unknown or other
  misc_feature (451)..(451): n is a, c, g, or t
  modified_base (583)..(583): a, c, t, g, unknown or other
  misc_feature (583)..(583): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctctggctcccaggtaccngctgtgacatccaattcgacccagtctccatcctcctgtctgcatctattgganacagatcaccatcacgttggccggganagtcaggccatcgagcgtattctttagcctggttncagcaacgaaaccgagggcgacgcccctnagtntcgtagtctatggtgcagtaccagtatcgacgtaagggttcgggtacccctagtcccgtaggttcaggtggactaggtcgactagtcgtagggaactagtacttacgaactcgtacactanacagacacgcctgacctacgtccgtagtaagtttntttagaacttaaatttattactgtaactaacgtaattaattactaaccggttacccgtaggtcgtaaccggttcggacggaaggggtaaccgaagggtacgtaagtaccgtaacggtaacgtaggcggtacngtacc

SEQ ID NO: 214980 - DNA, 663 bp, Homo sapiens
  misc_feature: GYAE6OF01BPCNM.1.34.D01.1.454.CMB.1.raw
  modified_base (201)..(201): a, c, t, g, unknown or other
  misc_feature (201)..(201): n is a, c, g, or t
  modified_base (325)..(325): a, c, t, g, unknown or other
  misc_feature (325)..(325): n is a, c, g, or t
  modified_base (649)..(649): a, c, t, g, unknown or other
  misc_feature (649)..(649): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacngagtcaccatcacgttcggccgggcgagtccgaggccatcagcgtattctttagccgtggttcgcagacaacggaaaccgcgggaccgacgccccctgacgtacgtcgtagtctaggtgggtcncataccgaagtatttcggacgtaaagggggttccgggtaccccagtacccggtaggttcgaaggtcgggcaaggttcgaccgtagttcggtacgggtactaacggtaacttaacccgaaccttcttaacccgtaacttaactcgaacgccgtacgccgtagccgacgtaccgtagtaagttcgttttacaacttaagttttacttactgttaactaacttaagttacttacgtaaccgtaccctaacggttacggtaccggttcccgggaccggtaacggggaaccgtacgggtagaaacgtaccgtaaaccggtagttacggnggacctcgtacccg

SEQ ID NO: 214981 - DNA, 623 bp, Homo sapiens
  misc_feature: GYAE6OF01AL779.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattcttagcctggttgcagcagaaccgngggcgacgccctnagatcgtagtctagtggtcgcagtccagtattaggtaacggtcgggtcccaagttccgaggttcgaggttcggcgtagtcgacgtagtccgtagggacacgtacttaccgcttactactaacttacgtacgacgacgtaacggtccctagccgtaacgtccgttaaggtaacgtttacgttttacggaactttaacggttttacttaacggttataaccgtaaacgttaagttactttaaggtaacctaacccgttaacggtcgggttacccgtacgggaccggtaacggtaccgtaaggtcggtaactacccgaacgtacggtgtcggacgtcgtactaccg

SEQ ID NO: 214982 - DNA, 736 bp, Homo sapiens
  misc_feature: GYAE6OF01E4CYS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccactccctccctgtctgctatctagtggagacagactcaccatctacgtcggccgggcgacgtcgacggtccatacgagtcgtatttcgttacggtccgttgggtcgacgaaggaccgaaacggaaaacccggcggggaccacccggtcccccgtagtaacgtacgtacggttagtcgtaggtcggtacacactaccgaagtagtacggaacggtacggggtccggtaccacgttaccggtaggttacgagggtcggtacgtacggtcgaccgtaggtacggtaacgggtaactaagttaacctacctaccgttacctaacttaacgtacgtaccgaacggccgtaaccgtccgtacggaccgtaacggttacgtaaggttaactttcgttttaacgtaactttaagtttaacctacgttactaaaccgttaattaacgtttaacgtaccgtaacccgttaccgtacgggttaccggaccgggttaccggaccggggtaaggaaccgggtaaggtacggtaaacccgtaaccgtaacggttcgtaggcgttcacgttaacccg

SEQ ID NO: 214983 - DNA, 779 bp, Homo sapiens
  misc_feature: GYAE6OF01CK60O.1.34.D01.1.454.CMB.1.raw
  modified_base (103)..(103): a, c, t, g, unknown or other
  misc_feature (103)..(103): n is a, c, g, or t
  modified_base (309)..(309): a, c, t, g, unknown or other
  misc_feature (309)..(309): n is a, c, g, or t
tcagacgagtgcgtcacgaccggtgctcgatttagatcgtctgtgttggggtttgggggagtcagaccctgtcaggacacagcatggacatgacgggtccccnctcagctccgtgggctcctgctgctctggcctcccgaggtaccagctgtcgactactaccaattcgaccctagtcctcctacttccctcccgtgtctcgctattctagtggacgacacgataccactaatccgtacgttcggccgggacgtacgtcgacggcctatcgacggtactacgtttcgttacgccgttaggttcacgtanacgaaacgtaaccggagggtcgaccgccctacgacgtactcgtagtctagtcggctctaagtcgtagtacgtcgacggtacggggtacgtacctacgtccggtagtacgacggttcgacggttagccgtacgtagtaccggtacggtaactacggtaccttaaccctcttaccgtaccttaactacgtaccggtaccgaacgttccgtacggtacggtacccgtacgttaaccgttaaggttaacgtttcgtttaaacgtttaacgtttaaaccttttacgtaaccgtttaacgtaaccgttaagtttaaacgttaaaccgtttaccgttaacccggttaacccggttagggttacccgggttacccggtaccgggtacccgggtaaaacggggtaaccggtaaggttaccgggtaaacccggtacgtaaacccggttaagggtcgtaaacgggtcctaaccggtacccg

SEQ ID NO: 214984 - DNA, 667 bp, Homo sapiens
  misc_feature: GYAE6OF01AWNFY.1.34.D01.1.454.CMB.1.raw
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcgaggccatcagcgtattctttagcctggttgcagacaagaaaccgagggcgacgcccctnagtactcgtagtctagtggtncactcgagtattggacgtaaggggtcgggtacccagtccgtaggttcaggtcggactagtcgctagtcggtgggaactaggtaacttacgaccttcgtactaactactcgacgacctaagccctaggaccacgaccttaggaaagtttctttacgaactttaaattttactacttacgttaacctaaagttacgttaatttaccgtaacccggtttaccccgtaagggttccgggtaaccggttacccggggtaccggtaaacggggggtaacccgtaaaggggttaccgggtaaacgttaaccccgggtaaaacccggttaacggtacgggttccggtaaccgttcggtaaaccccg

SEQ ID NO: 214985 - DNA, 726 bp, Homo sapiens
  misc_feature: GYAE6OF01E2HK8.1.34.D01.1.454.CMB.1.raw
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggcatggacatgagggtccccgctcagctcctgggggctcctgctgctctggctcccaggtaccagctgtgacatccaattgacccagtctccatcctccctgtctgcatctatggagacagagtcaccatcacttggccgggcgagtcaggccatcagcgtatttcttagcctggttgcagacaagaaaccagggcacgcccctanagatcgtagtctagtggtncatccagtacttgacgtaagggtcgggtaccagtccgtaggttcgaggtcggctaggtcgactagtcggtagggaactaaggtaacttaaccacttaccgtactaacttacgtacgaacgcctaacggcccttaggacctacgggtaccctaaggttaaacgttactttttacgaacctttaaagtttttaacgtttaacgttacgtaaaccttaaaacgttaacgtttaacgttttaaacgtaacccggttaacccccgttaaggggtaccgggttaacccgggttaccgggaccgggtaacggggtaaccgtaaaggggttacggaaaccggtaaccgtaaaaccggtaacggttacgggtcggtaaccttacggacccgtaacccgttagttcccggtttacgttacctttaacccgtacctttccccgtaccccggttaacc

SEQ ID NO: 214986 - DNA, 660 bp, Homo sapiens
  misc_feature: GYAE6OF01D40H9.1.34.D01.1.454.CMB.1.raw
  modified_base (102)..(102): a, c, t, g, unknown or other
  misc_feature (102)..(102): n is a, c, g, or t
  modified_base (555)..(555): a, c, t, g, unknown or other
  misc_feature (555)..(555): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtcctccactccctccctgtctgctattctagtggaagacagacgtccacctatcctacgtcggccgggacgagtcgacggccagtcaggacgtactttcgttacgtccgttggttcgactagaacaacggaaaaccggcgggacgaacccgcccctagacgtacgttcggtagtcgtagtcgggtacactacgtacctaggtacttacggacggtaacggggtccggtaccctagtccgtagggttacaggtacgactagggtccagtacgttacgtaggactagttacttaaccacttacgactaacttgacgcgtagaccgcgtcgactacgtccaagttactttagttactaagttaactttactaaggtcactaaaacggtttnttaacgtacgtacccgtacggtacgggtacgtaccggtaccggacggtaacgggaacgtagggtacgtaaccgtaccggtaacgtacgtaggtcctacgcgtacg

SEQ ID NO: 214987 - DNA, 787 bp, Homo sapiens
  misc_feature: GYAE6OF01CBL0G.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtggggctcctgctgctctcggctcccaggtaccagctgtgacactaccaattcgacccagtctccatcctccctgtctgctatctagttggacacagacgtaccaacagtcctacgttcggccgggcgacgtcgacggccatcgagtacgtagttttaccgtttacgccgtttgggttacgcgtaacgaccgaacggaaaccggacggggaccgtaccggtaccccctagacgtacgttcggttaacgttcgttaagttgggacgtactacgtaccgtaggtacgtttacggacggtaaacgggggttccgggtacccctaacgttaccggtacggtttacggacgggtacggacgtacgggtacgtacgtacggttaccgggacgggtactaacgggttaacttacccgttaacctttccgtaactacttaacgtacgaccgtacgtaccggtaccgtacggaccgtaccgggtaccttaggttaaacggttttactttacggtaacttttaacgtttttaacgtttaacgacggtttaaactaacggttaagtttaaccgtttacgtaacccgttaccggttacgggtacggttaccgggttacggacccgggtaagggtaaccggtacggtaggtaaccgtacgtaaacggtcgtacgtacggtcacggtac

SEQ ID NO: 214988 - DNA, 604 bp, Homo sapiens
  misc_feature: GYAE6OF01AJ83S.1.34.D01.1.454.CMB.1.raw
  modified_base (291)..(291): a, c, t, g, unknown or other
  misc_feature (291)..(291): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacaggacgtcaccatcacttcggccgggcgagtcaggccatcagcgtattcttagccttggttgcagcaagaaaccgagggccacgtcccctnagactcgtagtctagtcggtcgcatccgaagtcttacggacgtaaggggttccgggtacccaagtcccgtaggttcaggtggctaggtgactagtcggtaggactagtacttacnctcgtacatacncgagtccagccctagacgacgtccgtaagtaagttacgttttacgactttaacgttttaactaccgttagtaacctaacgttagttaacgtttaacgtaccgttaccccgtggttaccggtaccgttccggaccgtacggggactaagggtcgaaacgtccgtaaacggtcttaggcgctggaccc

SEQ ID NO: 214989 - DNA, 530 bp, Homo sapiens
  misc_feature: GYAE6OF01C5NTO.1.34.D01.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcaagaaaccagggcgacgcccctnagatcgtagtctagtggtgcatccagattgcgaaggtcgggtccagtccgagttcagtggcagtgcntctgggacngtatacactncactatcagcagcctgacacgcctaggaagtntttagactaaagttttatacgttagtactaaactagttaattactacgttacccgtaggtacggtcgttacggaccgtaggggaacctaagggtacggtaaacgtcgaaaccgtatggtacgctggacc

SEQ ID NO: 214990 - DNA, 738 bp, Homo sapiens
  misc_feature: GYAE6OF01A14N1.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatccctcctgtctgcatctattggagacagagtcacatcacttgaccggcgagtcaggccatcagcgtattcttagccttggttgctagcaacgaaaccgagggccgacgcccctgagatacgtagtctagtcggtgactatccaagtacgttcgacggtaacggggttccgggtacccacgttacccgacgggtttacacgggttgggaccgtaggttacgaccgtaggttacccgtagggggaaacctaggggtaactttaccgtaaccttccgtaccgtacgttaactccgaacggtaccgtaacgtacccgtggtacctaccggttaccctaaggttaaagttacgtttttacgaacccgtttaaagtttttaaccgttaccgttacggtttaaacctaaacggttatttaactttaaccggttaacccgtttaaaccccccggtaggtttaccggtaaccggtttacccgggacccggttaacgggggtaacctaaacggggttcggaaaaccgttaccggtaaaccccggttaagtacggtacgggttacgtccggtaaccc

SEQ ID NO: 214991 - DNA, 789 bp, Homo sapiens
  misc_feature: GYAE6OF01DP6KT.1.34.D01.1.454.CMB.1.raw
  modified_base (105)..(105): a, c, t, g, unknown or other
  misc_feature (105)..(105): n is a, c, g, or t
tcagacgagtgcgtcacgaccggtgctcgatttagatcgtctgtgttggggtttgggggagtcagaccctgtcaggacacagcatggacatggacgggtccccgntcagctccgtggggctcctgctgctctggcctcccgaggtaccagctgtagacactaccaattcgaccctagtcctccactccctcctgtctgctatcgtagtggagactagacgtcacatcacgttcggaccggagtacgtcaggccagtcgagtcgtactttcgtaggcgttaggtcacgagacgaacggaaccggcgggacacccgtcctagacgtcgtcgtaagtcgtaggtcgtcactactaccgtagtgtacggacgggtaccggggtaccggtacccctagttacccggtagggtttacgcgggtacggtacctagggttccgaacgttacgggtacggtaacgggtaacttacggttaaccttaccccggtaatttcccctaagtaaccgtttaccgacgttacggacccgtaaccggttccgtcggaacctttacgtaacggttttagtaaaccggttttagttactaacgttttaagtttacccgtaagtacggttaaacccagtttaacggtttttaaaccctacgggtaacccccggtttaacgtccggggttaacggtacccgggttaaacgggccgggttaaaccgggggtaataaacccgggggtctttaaaacccggtacccgttaacggggtacgtttaccggtacgggttcctaccccgggtaaac

SEQ ID NO: 214992 - DNA, 234 bp, Homo sapiens
  misc_feature: GYAE6OF01CX9SG.1.34.D01.1.454.CMB.1.raw
  modified_base (233)..(234): a, c, t, g, unknown or other
  misc_feature (233)..(234): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccgaggtaccagctgtgacatccaattcgacccagtcctccatccctccctgtctgcatctagtggagacagactcaccatcgactggccgggcagtnn

SEQ ID NO: 214993 - DNA, 697 bp, Homo sapiens
  misc_feature: GYAE6OF01C8QBZ.1.34.D01.1.454.CMB.1.raw
  modified_base (177)..(177): a, c, t, g, unknown or other
  misc_feature (177)..(177): n is a, c, g, or t
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggcatggacatgagggtccccgctcagctcctggggctcctgctgctctggctcccaggtaccatctgtgacatccaattcgacccagtcctccacttccctccctgtctgcatctagtgganacagagtcaccatcacgtcggccgggngagtcacggccatcgagtcgtattctttacgccttggtcncgagacaacgaaaccgngggaccacgtcccctagagtactcgtagtctagtggtnacctactaccgagtacgttcggacggtaacggggtcgggtcccctaagtcccggtaagggtcgaggtcgggactaggtcgtcgtacgtcggtagggaactaacgtaacttacctaccttcttaacgaactactacgacgtaccacgtccgacggacctaacggtacgttagtaaacgttagttttacgaactttaagttttactacgttagtaacctaattagtttaacttaacctaaccggttaccgttacgggtacggtaccgggtcggaaccggtaggggtaaccgtaggggtaccgtaaagggttcccgaaacggttacgtacggtacgtacgtacggacctacgtactttacgtcgtttacccttacacccgtttccccttccccctaccccg

SEQ ID NO: 214994 - DNA, 690 bp, Homo sapiens
  misc_feature: GYAE6OF01BPIGR.1.34.D01.1.454.CMB.1.raw
  modified_base (287)..(287): a, c, t, g, unknown or other
  misc_feature (287)..(287): n is a, c, g, or t
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctagttggagacagacgtcaccatcacgttggccgggcgagtcgacggccatcgagcgtatttcttaggccttggttgcagacaaacggaaaccgnggggaccgaccgccccctagagtacgtacggtacgtcgttagtggtcgactaacgtccgaagtagttggacggtaaggggtcgggtacccagttccgtaggttcgagggtcggctaggtcgctacgtcgtacgggactaacgtacttaccgacttccgtacaacttacnccgagccgacgtccgtagacgacgtccgtaagtaagttactttagaactttaatttaacgttacttacggtaactaacgttaagtttaacgttaacgttaacccggttacccgttacgggttaccgggtaccggttacccgggaaccgggaaggggtaacccggtaaaggggtaacggttaaacccggtaacgttaaacccgggtacggttggtaccggtcgtaccgtaacccg

SEQ ID NO: 214995 - DNA, 673 bp, Homo sapiens
  misc_feature: GYAE6OF01EFRY4.1.34.D01.1.454.CMB.1.raw
  modified_base (174)..(174): a, c, t, g, unknown or other
  misc_feature (174)..(174): n is a, c, g, or t
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
  modified_base (634)..(634): a, c, t, g, unknown or other
  misc_feature (634)..(634): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccatcctccctgtctgcatctagttgganacgagacgtcaccatcacgttcggccgggcgagtcgacggccatcagcgtatttcttacgccgtggtcncagacaacggaaccgngggccaccgccctagagtactcgtagtctagtggtcncatcgagtcttggacgtagggtccggacctagtccgtaggtcaggtcgacgtaggtcgacgtagtcggtaggaactagtaactacactactactaactacgtcgaacgccgtacgtaccgtcgaccgtacggtacccttaaggtaagttaccttttagaacttttaatttaacgttacgtacgtaacgtaaatttaacgtttaacgttaaccgtaacccggttaacccgttagggtaacccgggttacgggtaccccgggaagggtaacgggaaccgtaggggtaaccgaacggtaccgtaaacggtcgttagggtaccgcgtacgtcccaacggttnttaccgtcgttaacctcttaaccgtccccgtccgtaacg

SEQ ID NO: 214996 - DNA, 735 bp, Homo sapiens
  misc_feature: GYAE6OF01B09EE.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcaattgccgggcagtcaggccatcagcgattctttagcctggttgcagcaagaaaccgagggcgacgcccctanagactcgtagtctagtggtcgctatccaagtattggacgtaaggggtcgggtaccccacgtcccgtagggtttcagggtggacaggtgctagttcgtagggaactaagtacttaactactactacgtactactcaagtcacgccgtgacgacgtaccgttaggtaacgttaagtttttcgaactttaaagtttttaacttaccgttacggtttaaccaaacgttaacgtttaacgtttaaaccgttaaacccggtttaaccccccggttaaacgggtttacccggggttaaacccggggttttaacccggggtaccccggggttaaaacccgggggggaaaccccgggtttaaaaggggggttaaccgggtaaaaccgggtttaacccgtaaaaccccggggttaaaccggttccggggttaacggggtccgttaaccgggtaaaccccg

SEQ ID NO: 214997 - DNA, 854 bp, Homo sapiens
  misc_feature: GYAE6OF01BBPO6.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggcctcctgctgctctggctcccaggtaccagctgtgacataccaattcgacccagtcctccactccctccctgtctgcatctagtggagacagacgtcaccatcgtacgttcggccgggacgagtcgacggaccagtcagtcgtactttcgttacgtccgtggtcgacagacgaacgaaccggagggaccgaccggacccctacgtacggtacgttacggttagtaccgtaaggtgggtactaccgtactaccgtaggttacgttacggtacggtaaccgggggttccgggtaccctacggtacccggttacggttacgtaacggttcgggacgtaggtacgtaccgttacggttaccggtacgggtaaccgttaacgttaacgtttaccccgaaccgttttacctaaccccgtaaacgttaccgtaacccggaacgtaccccggaacgttacccggaccggttaaccgtaccggtaccggttaaggtttaaacgttttaacttttaaccggttaacgtttttaaacccttttacgtttaccggttaaccgtaaaccttaaggttaaacgttttaacccgtaccggtttaaaccccggttacccgttaacgggttaccggggttaaccccgggtttacccgggaaccgggtaaacgggggtacccggtaaaaggggtacccggtaaccgaaacccggtaaaccgttacgggtacggtaccgtccggtacccgtaacccg

SEQ ID NO: 214998 - DNA, 743 bp, Homo sapiens
  misc_feature: GYAE6OF01AP7FF.1.34.D01.1.454.CMB.1.raw
  modified_base (736)..(736): a, c, t, g, unknown or other
  misc_feature (736)..(736): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggcctcccaggtaccagctgtgacatccaattcgacccagtcctccactccctccctgtctgctatctagtggagacagtacgtaccaccatctacgttcggccgggcgagtcgacggcctatcgagcgtatttccgtttacgccgttggttcgcgaacgacgaaacggaaacccggaggggaccgaccgtccccgtagagtacgttacggttaacgttcgtaaggtggtacgactaacgtacctaaggtacgtttacggaaccggttaacggggggtacccgggtaccccctaagtttacccgggtaacggtttacgtaacgggttcggaccgtagggtttaccggacctaacggttaccggtagggaacctaacggttaacttaacccgtacctcgttaactaactacgtacgacgtcgtaccggcctgacccgtaacgtaccgtaagttaacgttatttacgacttttaacgttattacgtattaaccgtaagttacgttaattaccggtaaccgttaccgtagggtaccggttacggtacccggtaccgggtaagggaaccgttagggacgtaacctaccggtaacgtacggtagccggtacncgtaacc

SEQ ID NO: 214999 - DNA, 714 bp, Homo sapiens
  misc_feature: GYAE6OF01COGTO.1.34.D01.1.454.CMB.1.raw
  modified_base (220)..(220): a, c, t, g, unknown or other
  misc_feature (220)..(220): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcacatcacttgccgggnagtcaggccatcagcgtattctttagcctggttgcagcaagaaaccgngggcgacgcccctanagattcgtagtctagtggtcgcatccagtattgacgtaagggtcgggtcccagtcccgtaggttcaggtcggccaggtcgactagtccggtagggaactaggtaactttaccgacttcctacgtaaacttactccgtacgactacgccttcggacctaacggtcccgttaagggtaaacgtttaactttttacggaactttaaacgttttttaacgttaaccgtttaagttaacctaaaacgttaacgtttaaactttacggttaaacccggtttaaccccgttacgggttacggggttaacccggttacccgggtaacccggggtaacggggtaaaccggtaaacgggggttaacgggtaaaccgttaaccggtaaaaccccgggttaacgttaccgggtttacggggtacccgttccggtaaaccccgg

SEQ ID NO: 215000 - DNA, 598 bp, Homo sapiens
  misc_feature: GYAE6OF01DPT0K.1.34.D01.1.454.CMB.1.raw
  modified_base (196)..(196): a, c, t, g, unknown or other
  misc_feature (196)..(196): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctatggagacagagtcaccatcacttgccgggngagtcaggccatcagcgtattctttagcctggttncagcagaaaccgagggcgacgcccctanagatcgtagtctagtggtgcatccagtattgacgtaggtcgggtccagtccaggttcagtggcagtgctagtcgtaggacagtattacactctacaactatcagtcacgtcctggaccacgtaccgtagtaaagttacttttacgaacttaattttacgttactagtaacaacttaagttactttaacgtaccggttaaccccgtaagggttccggtaaccggtttccgggaaccgtacggggaaccgtaagggacggtaacgtaccgaaaccgtaactggtacgcctcggacctaccgtattcttacgttccttacaccttcccgttcccctaccccg

SEQ ID NO: 215001 - DNA, 797 bp, Homo sapiens
  misc_feature: GYAE6OF01BJSO0.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctcgtggcctcccaggtaccagctgtgacatccaattcgacccagtctccacttccctccctgtctgctattctagttggagacagacgtcaccatctacgttcggccgggacgacgtcgaggccagtcacggtcgtatttcgtttagccgttggttcgacaacggtaccgaaacggaaaaccggacggggtacccgaccgtcccccgtagaacgtacgttaccggttaagttccttaaggtcgggtacaccgtaacttacccggaagtacgttacgggaaccggtaaacgggggttccgggtaccctaacgttcccggtaaggttacgacgggttcggaacgtagggtcgacttacggttacggtagggaacctaaggtaaccttaccgaccttacggtaacctaacttacgtaccgacgtaccgtaaccggtcccgttaggaccgtacggttacccgttaagtaacggttttaatttaccgtaaatttaacgtttttactacggtacgttaaactaacgttaactttaacgttaacctaacccggtttacccgtcggggttaccggtaaccgggttaccgggaccggtaaaaccgggggtacttaaacggggtaacgaaccggttaaaccccgtaaacgggttacgtggtacggtccgtccgtaaacccgg

SEQ ID NO: 215002 - DNA, 647 bp, Homo sapiens
  misc_feature: GYAE6OF01CSSAA.1.34.D01.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctcctgtctgcatctattggagacagagtcaccatcacttcgccgggcgagtcaggccatcagcgattcttagcctggtgcagcaagaaaccgagggccacgcccctnagactcgagtctatggtnacatccagtattcgacgtaagggtcggtacccagtccgaaggttcaggtcggacagtgacaagtcgtacgggactagtacttaacactctacgtaactagtcagctagtcctaggaccagtcctaggtaattatttgaacttaatttacttacgtacgtaaccaaatacgtttaacttaacgttaccggttaacccttagggtaccgggttaccggttaccgggaaccggttaaacggggaacccgttaaggggaaaccgggtaaacgttacccgaaaccgggtacttacggggtcggtaacccgttcggaaacccttacgtaacgttccgttacggttaccttccgtaaccttcccggttccccgtaaccg

SEQ ID NO: 215003 - DNA, 752 bp, Homo sapiens
  misc_feature: GYAE6OF01DHQVA.1.34.D01.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacataccaattcgacccagtcctccactccctcctgtctgctatctagtgganacagacgtcactactctacgttcggccgggngacgtcgacggcatcgacgtcgtatttcgttacgccgttaggtcacgacgacgaaacgaaccggagggaccgaccgcccctagacgtacgtacgttagtctaggtcggtcgactacgtacgagtacgtcgacggtaacggggttccggtacctacggttaccgtacgggttacgtaggggtcgacggtaacggtcgtacgtacggttacgggacgggtaactaggtaacttacctacgttctactactacgtcgagtacgtacgccgttacgacacggtccgtaaggtacgtttacgtttacgtaaacgttttaacttttaacgttacgtacgttaaacctaaagttaacgtttaaccttaaccggttaacccggttaacccggttacggttaacccggggttaccggtaccggggtaacccggggtaacggggtaaacccggtaaagggggtaacccggttaaacggtaaacccggttaaaccggtaacggttggaccgttcccggtacgtaaccc

SEQ ID NO: 215004 - DNA, 716 bp, Homo sapiens
  misc_feature: GYAE6OF01DS6KV.1.34.D01.1.454.CMB.1.raw
  modified_base (283)..(283): a, c, t, g, unknown or other
  misc_feature (283)..(283): n is a, c, g, or t
  modified_base (340)..(340): a, c, t, g, unknown or other
  misc_feature (340)..(340): n is a, c, g, or t
  modified_base (694)..(694): a, c, t, g, unknown or other
  misc_feature (694)..(694): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggcctcctgctgctctggcctcccgaggtaccagctgtgactataccctaattcgacccagtcctccactccctccctgtctgcatctagtggagacagactcaaccatcacgttcggccgggacgtagtcgacggccatcgagtcgtatttcgttacgcgttggtcncgagaccgaacggaacgcggaccgaccgcccctagacgtcgtcgtagtctagtgganactactaccgtagtagtcggacggtacgggtccggtaccctacgtccgtaggtcgtagggtcgtaccgtaggtcgaccgttagttcgaacggggtaaccttagtaccttaacctaccgttacctaaccgtactacgtaccgagggtacccacggtcctacggaccgtaccgtacgttaaggtacgttttagtttacaatttaaccgttttacttacgtaaccgttaacaaacgtttaacgttaaccgtttacgtaaccccgtaccgggtttaagtacccgggttaccgggttaccggacccggggtacggtaaaccggtaacgggtaacgtaacgttaacccgaacggttacgngggttaccgcggttaactcccg

SEQ ID NO: 215005 - DNA, 566 bp, Homo sapiens
  misc_feature: GYAE6OF01EB5LW.1.34.D01.1.454.CMB.1.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaaccgngggcgacgcccctnagtatcgtagtctatggtncatccagtattggacgtaaggggtcgggtccccagtcccgtaggttcaggtggacgagtgcagtcgtagggacagtacttacactcgtacactacacgagcacgcctgcacgtccttagaattntttagacttaattttactactgtactaaactattaattacgtaccgttaacccgttacggtggtaaccggttcggaccggtaacggggtaacctagggtacggaaagtccgaaacggtacgtggtcggacgtgacccg

SEQ ID NO: 215006 - DNA, 686 bp, Homo sapiens
  misc_feature: GYAE6OF01D3P8T.1.34.D01.1.454.CMB.1.raw
  modified_base (103)..(103): a, c, t, g, unknown or other
  misc_feature (103)..(103): n is a, c, g, or t
  modified_base (209)..(209): a, c, t, g, unknown or other
  misc_feature (209)..(209): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgacgggtccccgntcagctccgtgggctcctgctgctctggcctcccaggtaccaggctgtgactactccgtaattcgaccctagtcctccatccctcctgtctgctatctagtcgganacagatcaccagtcacgtcggccggcgagtcgacggccatcgagtcgtactttcgtttacggccttagggtcgacgagaccaaacggaaaccggngggccaccgcccctagaagtcgtacgtagtctagtggtacactacncgaagtagtcggacgtaagggggtccggaccctagtcccgtaggttnaacgggttgacgtagtcgactacgtcggagggaactaagtacctttaaccaccctttataaccctaacgttaactccgggaactcccgtaaccgtcccgttaggacctaaccgtcgttaaggtaacgttttgtttaacgaactttaatttaacttacggtacgttaactaaacgttattccgttaacgtaacccgttaccgtagggtccggtacgggttaccggaccgggacgggtaacgtaacggtacggaaagttacccgaaacggtgtgggacctcgtcaacccgg

SEQ ID NO: 215007 - DNA, 663 bp, Homo sapiens
  misc_feature: GYAE6OF01C49LZ.1.34.D01.1.454.CMB.1.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctatgganacagagtcaccatcacttggccgggcgaagtcaggccaagtcagcgtattctttagcctggttgacagacaagaaaccgaggggacgacgccccctanagactcgtagtctaagtggngcaatccaagtgttacgacgtaagggtcgggtccaagtcccgtaaggttccaaggttcgggaccaggttacgccaagtttccggagggaacctagtaacttaccacttacctacgaactacttacgacggtctaacggcctacggacgacgtaccgtaagtaaagttgttttaacaactttaaattttacgttaacttcggtaaacctaaacgtagtttaaacttaacgtaaccgtttaacccccgaaggttccggtaaaccggtttcgggacccggaaaggggaaccgtaacggggtacggaaacgttacccgaaaacgtaccgtaggtaccggtgtccgtaaccg

SEQ ID NO: 215008 - DNA, 791 bp, Homo sapiens
  misc_feature: GYAE6OF01BV5IC.1.34.D01.1.454.CMB.1.raw
  modified_base (410)..(410): a, c, t, g, unknown or other
  misc_feature (410)..(410): n is a, c, g, or t
  modified_base (772)..(772): a, c, t, g, unknown or other
  misc_feature (772)..(772): n is a, c, g, or t
tcagacgagtgcgtcacgaccggtgctcgatttagatcgtctgtgttgggttgggggagtcagaccctgtcaggacacagcatggacatggacgggtccccgctcacgctccgtggggcctcctgctgctcgtcggcctcccgaaggtaccagctagtgactactaccgtaattcgaccctagtcctaccctacttccctccctgtcctgcctattctagtgacgacagctacacctatcacgttcggccgggacacggtcgaacggcctagtacgaggtccgttattttccgtttacggtccgttgggttcgacgtaacggtaccgaaaacgtaaccggtacggtcggaacccggtacccgtccccgtaagtacggtacgttacggttacgttacgtagtaccgggttnaccgtacgttacgtaacgtacgttcggaaccgggtaacgggttccgggtacctaacggttccgtacgggtttcgacggtcggtaacgtgtacgtacgtacgttcgggtacgggaactttcgtaacttaccgtccttactaaccggtatcgtaacggactccgaccgtctacgggactcggttaccgtaacggttagttactttacggaacttttaattccgtaattacccgaattaacgttaagtttacccgtaaaccggttacgttaaacccgtacgggttccgggtacccgtaaccgggggaacggtaacccggggttacaaaccggggttacgtaaccccggtaaagtacccgggttanacgggttccgacccgtacg

SEQ ID NO: 215009 - DNA, 740 bp, Homo sapiens
  misc_feature: GYAE6OF01A17MU.1.34.D01.1.454.CMB.1.raw
  modified_base (101)..(101): a, c, t, g, unknown or other
  misc_feature (101)..(101): n is a, c, g, or t
  modified_base (119)..(119): a, c, t, g, unknown or other
  misc_feature (119)..(119): n is a, c, g, or t
  modified_base (150)..(150): a, c, t, g, unknown or other
  misc_feature (150)..(150): n is a, c, g, or t
  modified_base (330)..(330): a, c, t, g, unknown or other
  misc_feature (330)..(330): n is a, c, g, or t
  modified_base (733)..(733): a, c, t, g, unknown or other
  misc_feature (733)..(733): n is a, c, g, or t
tcagacgagtgcgtcacgaccggtgctcgatttagatcgtctgtgttgggttgggggagtcagaccctgtcaggacacagcatggacatgagggtccccgntcagctccgtgggctccngctgctgtggctcccaggtaccacgctggtnacgtactcctaattcgacccctaagtctccactccctccctgtctgcctattcctagttggagactaggattccaacctatctaccgttggacccgggctacggtcagggcccaagtcgacggctaagttttcctttacggcccgtggtttcacgtaaggtaccgaaaggtaaaacccgngggaccggtaccgcccccgtagaacgtcgttaccggttaacgtacgttagtagggttccgacctaacggtccctaaagttcgtccggtaaggtaacggggggttccgttacccctaaaggttccgtaaaggggtttccgtaagtccgggtaccgtaagtcggtccaagtttaccgggaagggttaccaaagtaccggttaactaaccttcgtacaccgttagtacgacgtaccgtacgtaccgtcgttaccgacgtcccggtaagtaccgttattcgtaacttaacgtttactagttaccgtaactaaacgtttgttaacctaatacccggttaccgtacggtggtaaccgccggtacgagggtaccgttaaggacgaacgtccgtaaagtacccgtgcggtntacgacg

SEQ ID NO: 215010 - DNA, 1013 bp, Homo sapiens
  misc_feature: GYAE6OF01C2FC3.1.34.D01.1.454.CMB.1.raw
  modified_base (524)..(524): a, c, t, g, unknown or other
  misc_feature (524)..(524): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggcctcccaggtaccagctgtgacatccaattcgacccagtcctccactcctccctgtctgcatctatggagacagagtccacatctacgttcggccgggacgagtcgacggccatcgagtcgtactttacgttacggtccgttgggttcgacgaaggacaaaacgggaaaacccggacggggtacccggaccgtcccccgtacgaaggtacgttcggtaacggttcctaaggttcgggtacgacctaacgtaccgtagtaacgtttccggacgggtaaacgggggtttccgggtacccctaagtaccccgggtaagggttacgtagggttcgggacgtaacgggtcgtaccgtaacggtcggtaacgggggaacaacggtttaacttaacccnccggtttaactacccgtaaaaccttaggtaacccgaacggtcgtaacccggtcccgttaaggaccccggttaaaccgtaaccggtttaaacggggtttaaacgtttttacgggtttttaacctaaaaccccttttttaaagttttttaaacccgggttttaaaccgtttacccgggttaaacttaaaaacccggttttaacgggttttaaaacccttttaaacccgggtttaaaacccccgggttttaacccccccgggtttaaaaggggggttcccgggggtttaaaacccccggggttttaccccgggggggtaaaacccgggttaaaaccgggggggggttaaaacccccggtttaaaacggggggggtttaaacccggggttaaaaacccccgttaaaccccgggggtaaaaaaccccccgggtttaggggtttaacccgggggttacccgggggtccgtttaaaccccgggtaaaacccccggg

SEQ ID NO: 215011 - DNA, 706 bp, Homo sapiens
  misc_feature: GYAE6OF01B1K46.1.34.D01.1.454.CMB.1.raw
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattcgacccagtcctccactccctccctgtctgctatctagtggagacagacgtcaccatcacgttcggccgggtacgacgtcacggccatcgagctattcgttagcgtggtcgcgagaccgaacggaaccgaggggaccgaccgacccctgaacgtctcggtaatcgtagtcggacgactacgtaccgtagtacgttacggacggtaacggggtccgggtacctacgtacccggtaaggttacgacgggttacggacgtaggtacgacggttaaggtccggaaacggggtaactaacggttaacttaaccgtacttaccgtaccgtactaacacgaacgtctacggtccctaggtcctaacgtccgtaagtaacgtttagttttacaactttaatttacgtacgtaacgtaccgtaaacttagttaacgttaccgttaaccgtacccgttacgggtaccggtaccgggtaccggaaccgggtagggaacccggtagggtaaccggaacgtaacccgtaaacggtcttacgggtactcgtacgtacccg

SEQ ID NO: 215012 - DNA, 415 bp, Homo sapiens
  misc_feature: GYAE6OF01BW2UV.1.34.D01.1.454.CMB.1.raw
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (392)..(394): a, c, t, g, unknown or other
  misc_feature (392)..(394): n is a, c, g, or t
  modified_base (396)..(415): a, c, t, g, unknown or other
  misc_feature (396)..(415): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgactaattttagttactgtacaacagttattatacgtaccctagtcggtacgtcggccagggacaggtgaagtcacgatgtgntncacatctgtcttcactcctcccgcatctacgacgctactcgtcgngacgcgggctcgggacaacggcgacatagnnngnnnnnnnnnnnnnnnnnnnn

SEQ ID NO: 215013 - DNA, 614 bp, Homo sapiens
  misc_feature: GYAE6OF01B5EZ2.1.34.D01.1.454.CMB.1.raw
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtcggggtcccatccgaggttcagtggcagtgcatcgtgggacagtattacactctcactatcgagccacgcctgccacgtcctaggaacgtattttcgacttaattttacgttactcgtactaacgtagttaactttacgtaaccggttacccctacggtcggtaccgtttccggacgtacgggggacctaagggtcggaacgtccgaaccgtaatcgggtcggtcctcgacctaccgtactcgtcgtcttccacgttcccttcccgaccctccgtacgaccgtcaacgttccgtactcggacggtccggggactcgggacgacggtccgctacgtacgcncgtcncacgngtccgtagctcgngtcncngacgtcngtacgcgtcacgtcagtcgatcgtgacgttccgagtcgactacggtcgttacgacttacgcgttaaacgtcgtcgtaccgtcggttacg

SEQ ID NO: 215014 - DNA, 748 bp, Homo sapiens
  misc_feature: GYAE6OF01B55QQ.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggcctcctgctgctcgtggctcccgaggtaccagctgtagactataccaattcgacccagtcctcctactccctccctgtctgctatctagttggagacagacgtccactactctacgttggccgggacgagtaccgacggcctaagtcgaacgtaccgttactttaccgtttacgccgttagggttacgaccgacgacgaaaccggaaccggagggaccgacccgcccctagaacgtacgttacgttacgtcctaggtcggtacgctaacgtaccgtaggtacgttacggacggttaacggggtccgggtacccaacggttaccggaggtttccgaaggtcggacgtacggtcgtactagttccggagggactaacgtacttactaccgttactacctaacgttacgtacacggacctacgcccgttaacgcgtaaccgtacgtttaacggtaagtttctttaacgtaacttttaagtttaacttaccggtaattaccgtaaacgttacgttaacgtttaccgtaaccggttaccccggttagggtacccgggtaccgggttaccgggaaccgggtaaggaaccggttagggtaacgaaccgttaaccgaacgtggacgtcgaccgtcgac

SEQ ID NO: 215015 - DNA, 701 bp, Homo sapiens
  misc_feature: GYAE6OF01BFWK1.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctcgtggctcccaggtaccagctgtgacatccaattcgacccagtcctccactccctcctgtctgcattctagtggagacagacgtccaaccataccacgttcggcccggggacgagtccacgggccaagtcgacgtccgtatttccgtttagccgttggttgacagaccgaacggaaaccgagggaccgaccgcccccgtagacgtattcggtagtcttagtggtagaccactaccgaaggtagttacggacggtaacggggtccgggtaccacgttccgtaacggttcgaggtcggcgtagtcggtctacgtcgtagggactagtaaccttacgactcctacgtactactacgacgcctacgccgtagaccgactcgttaagtagtttaatttaccgactttaagtttaacttacggtacttacaaacgtttagttaactttaccgtaacccggtttaacccgtagggttacgggttaacccgttccggggaacccggtaaaggggtacccggtaaagggtcccgggtaaacgacccgtaaacggtacggtggtacgtacgtcgtaaacccg

SEQ ID NO: 215016 - DNA, 896 bp, Homo sapiens
  misc_feature: GYAE6OF01AP098.1.34.D01.1.454.CMB.1.raw
tcagacgagtgcgtcacgaccggtgctcgatttagatcgtctgtggttgggtttgggggagtcagaccctgtcaggacacagcatggacatggacgggtccccgctcagcctccgtggggctcctgctgctctcggctcccgaggtaccagctgagacactaccgtaagttcgacccctagttcctccctactccctcccgttgtccttgactattcgttagttgggaagacgtagacgtaccaacctagtccgtcgttcgggaccgggacgtacggtcgacggacctacgtcgacggtcgttacgtttccgtttacggccgttaggttccgacgacgaaccgtaaacgggaaccggaccggggtaccgtacccgtaccccgtacggtaacggttaccgttaccggttacgtaccgttaggttcggtaccgacgtacgtaccggttaggtacgttacggaccgggtacgggggtaccggttaccgtacggtcggttaacgggtaccgaggttacgggactagtacggaccgtaggtacggtaacgggtaacgtaacgttaacccgttactacccgttcttaaccgtaacctacgtaaccggtccgaacctcggttaccccgtaacggttaccgaggttaacccgtttaaggttaacttttaaccgtttcgtaaaattttcgttttaacccgtacggttaacgttaaaccgttaacggttttaacttaaaccgtaacccggttttaacccgggtacccgtttagggtaccccgggttaaacggggttaaccccggaacggggttaaccgggtaaacgggtaaccggttacccggggttaaaccgttaaccccgggaaacggtttcccggagggaccccttggaaacccttacccggg

SEQ ID NO: 215017 - DNA, 733 bp, Homo sapiens
  misc_feature: GYAE6OF01A0RJM.1.34.D01.1.454.CMB.1.raw
  modified_base (270)..(270): a, c, t, g, unknown or other
  misc_feature (270)..(270): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttggccgggcgagtcaggccatcagcgtattcttagcctggttgcagcaagaaaccgngggcacgcccctacagtactcgtagtctagtggtcgcactccgagtatttggacgtaaggggttcgggtaccccagttacccgtaggtttcaagggttcggaccaggttacgactacgttcggtaacggggaacctaggtaactttaaccaccgttcgtacctaccttataccgaacgtccgaacgtcctacggacctacgtaccgttaggtaaacgtttacgttttacgtaacctttaagttttttaacttaccggttacgtaaccgttaaacgttaacggtttaacgtttaaccgttaacccggtttaaccccggttaacgggtttaccggggttaacccgggtttacccggggaacccggttaaaccggggggtaaaccgtaaaggggttacggggttaaaacccgtaccccggtaaaaccggttacggttaggtccggggtaaccttcggtaaaccccg

SEQ ID NO: 215018 - DNA, 627 bp, Homo sapiens
  misc_feature: GYAE6OF01AXVFC.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctagtggtgcatccagtattgcaaggggtcgggtcccatccgaggttacaggtggcaggtcgactagtcgtaggggactaggtaattaccacttctactacttatcaacgcacgtcctagcctacggtcctaggaaagttacttttagacttaaagttttacttaccgtagttaaccgaaacttagttaattaaccgtaaccgttaacccccgttaggttaccgggtaccggtttacccgggacccggtaaggggggtaaaccctaaagggggttacgggaaacgttaacccggaaacccggtaaccgttagggtcgggaccgttcggaaaccccg

SEQ ID NO: 215019 - DNA, 698 bp, Homo sapiens
  misc_feature: GYAE6OF01EXK9C.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtctccatccctccctgtctgctatctattggagacaggatcaccatcacgttgccgggcagtcaggccatcagcgtatttccgtttacgccgttgggttcgacaggtaccgaaacgaaacccgaggggaccgaccggccccctagacgtactcggtagtctagtggtgacatcagtagtgacgaagggtcggtacccagtccgaaggttcaggtcggcgagttcgactacgtcggtgggaactaggtaacttacccgaccttacgttacctaactttacgaccgaacgaccgtaccgtcctaggtaaccctaggtaccccgtttaagtaaagtttacgtttttacgaacttttaacgtttttaattaccggttactaacccgttaaagttaacgttaattaaccggttaccgtaaccccgttacgggttaccggtaaccgggtttaccgggaccggtaacgggggtaaccgtaaggggttacgtaaaccgtaccgtaaacccgggtacttcgggtcgtcccgtggtaccc

SEQ ID NO: 215020 - DNA, 921 bp, Homo sapiens
  misc_feature: GYAE6OF01CM2DL.1.34.D01.1.454.CMB.1.raw
tcagacgagtgcgtcacgaccggtgctcgatttagatcgtctgtgttgggtttgggggagtcagaccctgtcaggacacagcatggacatgagggtgcccgctcagcgcctgggctcctgctgctctcggttcccaggtgccagatgtgccagtccggatcgacccagtctccattcctcctgtctgcatctgtaaggagacaggacggacctacctttcacgttgcgtggggacagtcgacggccagtacaggccgtaattttccgtttacgccgttggttacgacaagaccaaacggaaacccgagggaccgaccgtaccccgtagaacgtacgttacggtaacgttcgttaagtcgggtacgactaacgtacccgtaagtacgttacggaacggtaacggggttccgggtaacccctaggtaccccgtaagggtttaccgaagggttcgggaccgaagggtttacgaccgttaaaccgggttcggttaacgggggaaccaaacgggtttaaactttaaccccgtaaaccgtttcccttaaaacccggtaaactttaaacgacccgtaaacggtaccgttaaacccgggtcccggtttaacgacccggtaacggttaacccgtttaaagggttaaaccttttaacggttttttaacggaaaacttttttaaaacggtttttaacgtttaacccggtttaagttaaaccgttaaaacctttaagtttaaacccgttttaaaccggtaccccccggtttttaaaccccggttaggggttaaaccgggttaacccgggtttaccccggggaaccggtttaaacggggggtaaaaccccgttaaagggggtaaaccggtaaacccggtttaaacccggaaacccggttaaaccgggtttacgggaccggttacccgtaaccgg

SEQ ID NO: 215021 - DNA, 564 bp, Homo sapiens
  misc_feature: GYAE6OF01EC4LG.1.34.D01.1.454.CMB.1.raw
  modified_base (287)..(287): a, c, t, g, unknown or other
  misc_feature (287)..(287): n is a, c, g, or t
  modified_base (553)..(553): a, c, t, g, unknown or other
  misc_feature (553)..(553): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattgacccagtctccatccctccctgtctgcatctattggagacagagtcaccatcacttgccgggcgagtcaggccatcagcgtattctttagcctggttgcagcaagaaaccagggcgacgccccctnagatcgtagtctagtggtgcatccagtattgcgtaaggtcgggtcccagtcccgaggttcaggtggcagtcgctagtcgtagggactagtacttaccacttctactactatcaagcacgcctgcagtcctagtaagtattttgacttaattttacttactagtactaaactagttaattacgtaccgttaccccgtaggtcggtaccggttccggaccgtaaggggacgtaagggtacggtaacgtaccgtaaccggacgttaggngtcgtcggacc

SEQ ID NO: 215022 - DNA, 631 bp, Homo sapiens
  misc_feature: GYAE6OF01E01YU.1.34.D01.1.454.CMB.1.raw
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcctcctgctgctctggctcccaggtaccagctgtgacatccaattcgacccagtcctccatccctcctgtctgcatctattgganacagagtcaccatcacgttggccgggcagtcaggccatcagcgtattcttagccgtggttgcagcaagaaacccgngggccgacgcccctagacgtacgtcgtagtctagtggtcacactaccgagtattggacgtaaggggtcgggtacccagtcccgtaaggttcgtaggtcggctaggtacgctagtcgtacgggaactagtacttaacctcttacctctaactagtacgagtccacgtccgtgacgcgtctagtaagttctttacgaattaatttacgtactagtaaacctagttagttaattaacgttaccgtacccggttacggtcggtaaaccggttcggaaccgggggggaaaggaaccggttaagggtacggtaaaaccgtaccgaaacccggttaagttcggacgggtactccgggtacc

SEQ ID NO: 215023 - DNA, 645 bp, Homo sapiens
  misc_feature: GYAE6OF01AD049.1.34.D01.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggtgcagcagaaccngggcacgcccctnagactcgtagtctagtggtgcagtccagtagttcgacgaaggggttcggggtaccccagtccgtaggttcgaaggtcgggctaagggtcgtactaagttccgtagggggactaaggtaactttaaccgacttccgtaacctaacgttactcgaacgcctacgtacccgttgacccgaacggtcctaaggtaacgttattttacggacttaaattttactacttacgtaactaacgttagttaacttacgtaaccgttaccccgttaggtaccgggtaccggttaccgggaccggaaggggtaaccgaacgggttacggtaaaggttacccgtaaaccggttaacgtaggtcggtctcggtaacccg

SEQ ID NO: 215024 - DNA, 853 bp, Homo sapiens
  misc_feature: GYAE6OF01C6YIB.1.34.D01.1.454.CMB.1.raw
  modified_base (157)..(157): a, c, t, g, unknown or other
  misc_feature (157)..(157): n is a, c, g, or t
  modified_base (175)..(175): a, c, t, g, unknown or other
  misc_feature (175)..(175): n is a, c, g, or t
  modified_base (369)..(369): a, c, t, g, unknown or other
  misc_feature (369)..(369): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggctcctgctgctcgtggcctcccgaggtaccagctggtnacactccaattcgacccngtcctccactccctccctgtctagctattctagttagggacgacagtacgtaccaacctactccgtacgtttcgggcccggggtacgaacggtccgacgggacctaacgttcgacggtaccggtttaacttttccgttttaacggtcccggtttgggtttacgacccgtaagaccggaaacggaaaaacccggngggggtacccgacccggtcccccgttaacggaacgtacgttacgttaacgtcgttagttcggtacgactacgtacgaggtacgttacggacggtaacgggggttccggtaccctacgttacccggtaggttaccgagggttacggacgtacggttacgacgttaacggttcgggtaaacgggtacttaacggttacccttaaccctaccgtttaacccttaccgtaaaccttacggtaaccgaacggtaccgtttaaccggcccgttacggaacgttaacccggttcggttaaagtttaagtttacgtttaccgtaaattttaactttaacgttacgttaacggtaactaacgtttagttaacctttacggtaacccttccggttagtacccggggttaagtacccgggaacgggtaaacggtacgtaaacggggttaccgaaacctacggtaaccggttatcgggtaacctggtaccaacccg

SEQ ID NO: 215025 - DNA, 508 bp, Homo sapiens
  misc_feature: GYAE6OF01CWNGY.1.34.D01.1.454.CMB.1.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggcgatcagcgtattctttagcctggttgcagcagaaaccngggcgagcccctnagatcgtagtctatggtncatccagattgcgaagggtcgggtcccatccgaggttcagtggcagtgcagtcgtagggacagattacactctcactatcagcagcctgcagctagaatattttagacttaatttatactgtacaatagttaattagtacgtaccctagtcggtacgttacggcgagggtaccaagggtgaacgtacgaaccgtatggtggcgtcgac

SEQ ID NO: 215026 - DNA, 723 bp, Homo sapiens
  misc_feature: GYAE6OF01C6KV7.1.34.D01.1.454.CMB.1.raw
  modified_base (202)..(202): a, c, t, g, unknown or other
  misc_feature (202)..(202): n is a, c, g, or t
  modified_base (547)..(547): a, c, t, g, unknown or other
  misc_feature (547)..(547): n is a, c, g, or t
tcagacgagtgcgtcacgaccggtgctcgatttagatcgtctgtgttgggtttgggggagtcagaccctgtcaggacacagcatggacatggagggtccccgctcagctccgtgggctcctgctgctctggcctcccaggtaccagctgtgacataccaattcgacccagtcctccactcctcctgtctgcatctagtgganacagacgtaccaccatcacgttcggccggcgaacgtcgaggccatcgagtcgtatttcgttagccgttggtcgacagacgaacgaaccgagggccgaccgtccctagaacgtacgtccggttagtacgtagtcgggtcacgtactaccgagttacgttcggaccggtaaggggttccgggtaccctacggttaccggtaggttacgagggttccggatacggtcgtaccgtaacgttacgggtaggtaaccgtaagttaacttaacctacccgttacacgttaaactacgttccgaacgccgtaacccgtcgcgtaccgtacgtaccgtttaaggtaacgttttnttaacgttacgtttaaacgtttacttaccgttgtaaacttaacgttagtttaacgttaccgtaacccggttaacccgttcgggtaaccggttacccgggttacggaaccggggtaaggaacggttaacggaacgtaccgtaacccgaaaggttccgtggtacgtcgtcgtaacccg

SEQ ID NO: 215027 - DNA, 774 bp, Homo sapiens
  misc_feature: GYAE6OF01B0EH0.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgtattcttagcctggttgcagacagaaccgngggcgacgccctnagtatcgtagtctatggtgacatccgagattggacgtaaggggtcgggtaccccagtacccgtaggttcgacggtcggtaccgaggttcgacgtaagtcggtacggggaacctaggtaaccttaaccgtaccttccttaaccgtaacttacgtacccgaacggtacctaaccggtccctacgggtacctaaccgggtaccccgttaagggtaaaacgttttcgttttttaaccgaaacgtttaaacttttttaacgttaaccgttacgttaaacctaaacgtttaacgttttaactttaaccgtttaaacccggttaaccccccgtttaaggggtttaccgggttaaaccccgggtttacccgggggaaccccggttaaagggggggaaaccccggtttaaagggggttaaccgggttaaaaccgggtaaaccccggttaaaaccgggttacccggttaggggttaacccgggtcctaacccgggtaaccccg

SEQ ID NO: 215028 - DNA, 790 bp, Homo sapiens
  misc_feature: GYAE6OF01BIF2B.1.34.D01.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacataccaattcgacccagtcctccactccctcctgtctgcatctagtgganacagcgtccaccatcacttggccgggcgagtccaggccatccgagcgtatttcttacgccgttggttgcagacgaacgaaaccgngggccgacgcccctanagtactcgtagtcttaagtcggtancataccgtaagtagtacggaccgtaacggggttccgggtaccccaagttcccggtaagggttaccgaagggttcggaccgtaggttcgaccgtagtacggtacgggaactaacgtacgtttaaccacttaccgtacctaacgttacgcgaacggtacccgacgtcccggtaagaccgtaacggtccttaaggtaaacgtttaacggttttacgtaactttaaacgtttttaactttacccggaacggtttaacctaaaaccgttaaggttttaaaacctttaccgttaaaccccgggtttaaaccccgttcgggggttaaaccggttaacccgggtttacccgggtaacccgggtaaaacggggggttaacccgttaaacggggttaaccggggtaaaaccgttaacccccgaaaaccgggttacccgttaaggggtccgtaccccggtaacggtaaccccg

SEQ ID NO: 215029 - DNA, 801 bp, Homo sapiens
  misc_feature: GYAE6OF01BY1HK.1.34.D01.1.454.CMB.1.raw
  modified_base (227)..(227): a, c, t, g, unknown or other
  misc_feature (227)..(227): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatccctcctgtctgcatctatggagacagacgtcaaccatctacgtggccggggngaacgtcgaggccaatcgaagccgtattcttaggccgtaggttgcgagacgaacggaaaccgacgggacgaaccgcccctagagtagtacgtactacgtagtggtcgactactaccgaagtagtcggacgtaacgggggttccggacctaacgtccggtaaggtttacgaaggttcggacgtaaggttcacgtacgttaccggtaggggaacctaacggttaacttaaccctaccgttaaccttacctaaacgtttaccgaacgaacggaaccgtaacgtacccggtacggacccgtaacgttacgtaaaggttaaacggttttagtttttaaccggaaactttttaaagttttaaacttaccgtttaacgtaaaccgttaaaaccgttaaggttttaactttaaaccggtaacccggtttaaacccggttaacgggttaccggggtaacccgggtttacccggggaacccgtaaacgggggggtaaaacccgttaagggggtaaacccggtaaaccgggttaaacccggtaaaacggtaacggttaacgggtcggtaacgtccgtaaacccgg

SEQ ID NO: 215030 - DNA, 622 bp, Homo sapiens
  misc_feature: GYAE6OF01CDVYF.1.34.D01.1.454.CMB.1.raw
  modified_base (116)..(116): a, c, t, g, unknown or other
  misc_feature (116)..(116): n is a, c, g, or t
  modified_base (217)..(217): a, c, t, g, unknown or other
  misc_feature (217)..(217): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
tcagacgagtgcgtcacgaccggtgctcgatttagatcgtctgtgttgggtttgggagtcaggccatcagcgattctttagcctggttgcagcaagaaaccagggcgacgcccctnagatcgtagtctatggtgcatccagtattgacgaagggtcggggtcccatccgaggttcaggtggcagtgcatcgtgggacagtaattacactctacatancagcagtcctgcagcctagaaagtattttagacttaaagttttatactagtaacaactagtaatttactaaccgtaccccgtaggtacggtacggttccggaccgtaaagggggaaccaagggtaggaacgtaacctaaaccgaagtgtacggctacggacctaacctatccgtagttcctactacgttacccgttaccccgactacgtacgtaaccgaaaccgtctaaccgtcgttacgaggaacgggtcgggtcgtacggaaccgtaaagggccctaaggtaaactagagacgtacacgagacgacgagacganacganacgacagactacgactacagagtagtacgacgtacgacacgagacgtactagacgcgacgtacgacgtacagactactgtgtac

SEQ ID NO: 215031 - DNA, 407 bp, Homo sapiens
  misc_feature: GYAE6OF01A6XIO.1.34.D01.1.454.CMB.1.raw
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
  modified_base (394)..(407): a, c, t, g, unknown or other
  misc_feature (394)..(407): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcacgcctagaagtattttgactaattttattactgtacaactagtattatacgtacccctagtggacgttcggcgaggggaccaggtggaacgtcaaccgatgtggctgacacatctgtcttcactcctccgcatcagaacncactcgtctgacgcgggntcggcaaggtccncagtgnnnnnnnnnnnnnn

SEQ ID NO: 215032 - DNA, 638 bp, Homo sapiens
  misc_feature: GYAE6OF01A07M9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcagcccctcagatcgtagtctatggtgcatccagtattgcaagggttcgggtcccagtccaggtttcagtggcagtgcatcgtgggacaggtacttacacttctacgactagtcacgtcaagcccttggaccacgtccctaggtaaacgttatttttcgaacttaaagttttacttaacgttcgtaactaaaccgttaagtttaacgttaaacgtttaacccggttaacccccttaacgggttacgggtaaccccggtttaccgggacccgtaaacgggggggaaccctaaagggggtttacgggaaaccggtttacccgaaaacccgggttacgttacgggttacgggcccgttcgggtaacccc

SEQ ID NO: 215033 - DNA, 714 bp, Homo sapiens
  misc_feature: GYAE6OF01EFYDU.1.34.D01.1.454.CMB.1.raw
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtcctccatccctcctgtctgcatctagttggagacagagtcaccatcacttggccgggcgagtcaggccatcagcgtattcttagcctggttgcagacaacgaaaccgngggccacgcccctanagtactcgtagtctagtggtnctatccagtattcggacgtaaggggtcgggtacccctaagtaccgtaggttcaaggtcggcaaggtcgactagtacgtacggggaactaggtaacttaaccgacttaccgtactaaacttaacgtaccgaaggaccacggtacccgttgaccgtacggtacccttaaggtaaacgtttaactttttaggaactttaaaaggtttttaacttaaccgttacgtaacctaaacgtttaagttaactttaaccgttaaccgttaaacccccggttaacgggttacgggtaaacccggtttccggggaaacccggtaaacggggggaaacccgtaaaggggtaaacggtaacggtaaacccgtaaacccggtaaacgttgggttacgggccgttacggaaccccg

SEQ ID NO: 215034 - DNA, 659 bp, Homo sapiens
  misc_feature: GYAE6OF01DDESZ.1.34.D01.1.454.CMB.1.raw
  modified_base (102)..(102): a, c, t, g, unknown or other
  misc_feature (102)..(102): n is a, c, g, or t
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgcaggacacagcatggacatgagggtcccccgntcagctccgtggggcctcctgctgctctggctcccaggtaccagctgtgacatccaattcgacccagtctccatcctccctgtctgcatctagttggagacagatccaccatcacgttcggccgggcgagtcacggccatcagcgtatttctttagccttggttgcagcaagaaaccgngggcacgcccctanagactcgtagtctagtgggtnctatccgagatttcggacgtaaacggggttcggggtaccctagttacccgtagggttcaaggttcgggactagtcgggactacgttccggttacggggaactaggtaaacttacccgtaccgttcctacaacttactcgaacgcgaccgtccttaggccaacggtccgttaaggttaaagttctttttaggactttaaactttttacgtacgttactacgtaaacttagtttaactttacgttaaccgtacccctttagggcggttaccggtacggacccggaaggggtaaccgtaaggtacggtaaacacccgtaaacggtaagtggtacgctcggtaaccc

SEQ ID NO: 215035 - DNA, 646 bp, Homo sapiens
  misc_feature: GYAE6OF01DQ6KN.1.34.D01.1.454.CMB.1.raw
  modified_base (254)..(254): a, c, t, g, unknown or other
  misc_feature (254)..(254): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaacagggcgacgcccctnagatcgtagtctatggtgcatccagtattgacgtaagggtcgggtcccagtccgaggttcaggtggcagtcgctatcgtgggacaggtacttacactctacactatcagtcacgcctgacagtaccgtagtaagttacttttcggacttaattttacttacgtcgtacctaacgtagttaactttacgtaacccgttaacccccgttaggttacgggttaccggtttccgggaccggtaacggggggtaaccctaaggggttacggtaaaccgtaccgaaaaccccgggttagttacgggttacggtacgttacggtaccctaacccgttaacgtttacccgttacgtttacccgtttaccaccgtttcccccgttccccccgtaccccccg

SEQ ID NO: 215036 - DNA, 912 bp, Homo sapiens
  misc_feature: GYAE6OF01B6KMS.1.34.D01.1.454.CMB.1.raw
  modified_base (171)..(171): a, c, t, g, unknown or other
  misc_feature (171)..(171): n is a, c, g, or t
  modified_base (291)..(291): a, c, t, g, unknown or other
  misc_feature (291)..(291): n is a, c, g, or t
tcagacgagtgcgtcacgaccggtgctcgatttagatcgtctgtgttgggtttggcatggacatgagggtccccgctcagctcctggggctcctgctgctctggctcccaggtaccagctgtgacatccaattgacccagtctccatcctccctgtctgcatctattgganacagagtccaccgatcacgttcggcccgggacgagtcgaacggtcctaatccgagtaccgtatttccgttttaacggccttgggttacgaccgaacggtaccgaaacgggaaaaacccgngggggtaccgaaccgtcccccgtaacgaacgggtaacttccggttaagttaccgttaacggtcgggttacgaccgttacgtacccgtaaggttaacgtttccgggacccggttaaacgggggttccgggggttaaccccctaaggttacccccggttaaggggtttccgaacgggttccgggtaccgtaaggttaccgtacgttaacggttacgggtaccggggaaacttaacggtaacctttaacccggaccttaccgttaacccgtacttacggttacgacggtaccgtaacggtcccgtacggaccgtaacggttacccgttaaggtaaacgtttacggttttagaaacccttttattttaaccgttaccggtacttaaccggtaaacttacggttttaacttacccgttaaccggttaaccccgttacgggttacgggttaacccgggttaaccgggacccggttaaacgggggaacccgttaagggaccggttaaacggtaacccgtaaacccgggttagttaccggggtacccgtggtaaccctaacccgtaccgtttaacgttacgttcccgttacgtttacccaacccggtttcccttaccccccggtaaccg

SEQ ID NO: 215037 - DNA, 609 bp, Homo sapiens
  misc_feature: GYAE6OF01CNWFQ.1.34.D01.1.454.CMB.1.raw
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggcatggacatgagggtccccgctcagctcctgggctcctgctgctctggctcccaggtaccagctgtgacatccaattgacccagtcctccatcctccctgtctgcatctatggagacagacgtcaccatcacgttggccgggcagtcaggccatcagcgtattcgttagccttggtcnacgacaacgaaaccgagggcgacgccctgaagatcgtaagtctagtggtnacactaccagtacttgacgtaagggtcgggtaccagtccgtaggtcaggtcgacagtcgacgagttaccgagggaactaacggtacttaccaacttcctactaactacncgaagccaacggtcctagcgaacgtcctaagtaagttntttacgattaattttacactagtaacaagtaagtttaactaacgtacccgttaacccgtaggtaccggtacggttcggaccggtagggaaccgaggtaagtaacgtaccgaacgtacgtggacgtacgtaggccctaacgagttcttactaccgttaactacctcccgttaccggacc

SEQ ID NO: 215038 - DNA, 775 bp, Homo sapiens
  misc_feature: GYAE6OF01AFB32.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctccaggtaccagctgtgacatccaattgaccagtctccatcctccctgtctgcatctagttggagacagagtcaaccatcacgttcggccgggcgacgtcgaggccaatcagccgtaatttcctttaacggccgtgggttgcgagcaagaaaccggaggggccgacgcccctgaagactacggtagtctatggtgactactcaagtattcggacggtaacggggtcgggtaccctaagtcccggtagggttcgaggttcggacgtaggttcgctacgttcggtacgggactacggttactaaccgtacttacctactaacttactacggacgccgtaacgccccgttagaccctacggtacccttaggttaaacgtttacttttaacggtaaccttttaagtttttaaaccgtacgttaacggtaacccgttaaaaggttaacgttttaaacggttaaccgttaaccccggttaaccccggttaaacgggtttcccggggaaaaccgggttttcccggggaacccgggtaaaccgggggggtaaccgttaaaacggggggtaaaccggttaaaccgggtaccccgtaaaaacccggggttaacggttaccggttcggggtacccgttaacccggtaaaccccg

SEQ ID NO: 215039 - DNA, 689 bp, Homo sapiens
  misc_feature: GYAE6OF01B80BX.1.34.D01.1.454.CMB.1.raw
  modified_base (272)..(272): a, c, t, g, unknown or other
  misc_feature (272)..(272): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctccaggtaccagctgtgacatccaattcgaccctagtctccactcctccctgtctgcatctagtggagacagatcaccatcacgttcggccgggtcgagtcaggccatcgagcgtaactttcgtttaagccgttgggttcncgtaagacaaacggaaaaccgaggggccgacgaccccctacgaacggtaacgttccgttaacggttaccgttagttcgggttacgacctaacgtaccgtaagtagttacggaacggtaacggggttcgggtaccctacgtacccgtaggttacgtaggtcgggactaacggtcgacgtaagtcgggtacggtaacgtaacggtaacttaaccacgttacctctaacttactacgacgtacacgtcaggcacgtctaggtaacttagtttacaacgttaatttttaacgtactacgttaacacgttaagttaacttacgtaaccgttacccgttacggtacggtaccggttcggaccggaacgggtaactaaacgggtagaaccgttacgaaaccgttagaggttcgcgtcgtaaccg

SEQ ID NO: 215040 - DNA, 602 bp, Homo sapiens
  misc_feature: GYAE6OF01D383G.1.34.D01.1.454.CMB.1.raw
  modified_base (172)..(172): a, c, t, g, unknown or other
  misc_feature (172)..(172): n is a, c, g, or t
  modified_base (262)..(262): a, c, t, g, unknown or other
  misc_feature (262)..(262): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattgganacagagtcaccatcacttgccgggcgagtcacggccatcagcgtattctttagccttggttgcagcaagaaaccaggggcacgcccctanagatcgtagtctagtggtgcactccgagtattcgacgaagggtcggggtacccagtccgaggttcgaaggtggacagtcgctagtcgtagggactagtacttacactctacactatcagcacgtcctagcagcctagtaagttatttgacttaatttacttactgtacaacgtagttattacgtaccgttaccccgtaggttcggtaccggttccggaccggaaggggtaaccgtaagggtacggaacgttaccgaaaccggtacgttacgggtcgtacgtacgccctaacccgtagttccgttacttacccgttactaccttcccgttccccggtaccc

SEQ ID NO: 215041 - DNA, 803 bp, Homo sapiens
  misc_feature: GYAE6OF01AMRH0.1.34.D01.1.454.CMB.1.raw
  modified_base (160)..(160): a, c, t, g, unknown or other
  misc_feature (160)..(160): n is a, c, g, or t
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggtaggtcgagacctgtcaggacacagcatggacatgagggtccccgcgtccagctccgtcggggctcctgctgctcgtggctcccgaggtaccagctgtgacntccaagtcgacctagtctcactccctcctgtactgacatctagttgagtacagatccaccntacacttcggaccgggcaggtccagggtaccatcgaagcgtattcttacgccgttaggtcgcaggtaccaaggaaaaccgtgggaccgtacccggaccccgtcgtaacggacgtttacccggtaagttccgttaacgtggtcgaccgtacgtacccgtaggtaacgtttcggaccgttaaaggggggttccgggttacccaacggtttaccgacgggggtttacaacgggtttacgggaaccgcgggtttaacgcgtaaccttcggtaaccgggggtaacttaagtacgtttacgaacttccggtaactaactacgtacgactacgaccgtccgtagaccgtacgtacccggtagtaacttaacggttttacgagtttaacctttaagtttacgtaacgtttacgaaaaccgtttagttaacctttacgttaacccggtttaaccccgtaaacggttcggggtttaaccggttaaccggtaccccggggtaaagggttaccccggggtaaaggttacggtaaaacggttaccccggtaaacgggaacctttaaggggtccgttaaacgcgggtttaaaaccc

SEQ ID NO: 215042 - DNA, 737 bp, Homo sapiens
  misc_feature: GYAE6OF01D4322.1.34.D01.1.454.CMB.1.raw
  modified_base (103)..(103): a, c, t, g, unknown or other
  misc_feature (103)..(103): n is a, c, g, or t
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
tcagacgagtgcgtcacgaccggtgctcgatttagatcgtctgtgttggggtttgggggagtcagaccctgtcaggacacagcatggacatgacgggtccccntcagctccgtggggctcctgctgctctggcctcccaggtaccagctgtgacactccaattcgaccctagtctaccatccctcctgtctgctatctagtggaanacagactccaactatcgtacgttcgggaccgggngacgtcgacggcctaagtccgaaggtcgttacttttaccgtttaggtcccgttaggttacgacgtacggaaccaaacggaaaacccggacggggaccgaccgacccccttagaacggtacgttaccggttagttaccgttagtcggtcgactacgttaccgaagttacgttcggacggtaacggggttccgggtacctaagtaccggtaggttcgaagggtcggacgtagtacgactaaggtcggtacggtaactacgttaacttaccgaccttctaactaacttacgtacgacgtactacgttccgagtaaccgcgtacggttaagtacgttttacttactaagtttaactttaacttgtacgttaacgttaacttagttacttaaccggtaccttaacccggtagggttacggtaccggttaccggaacgggtaacgggaacgtaacgggtagaaaccgtaccgtaaaccggtagtaggtcgtcgtaacgtaccg

SEQ ID NO: 215043 - DNA, 715 bp, Homo sapiens
  misc_feature: GYAE6OF01BUO2F.1.34.D01.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattgganacagagtcaccatcacttggccggcgagtcacggccatccgagcgtatttctttagcctggttgcagcaagaaaccgagggcgacgcccctnagatcgtagtctagtggtcncatccagtattggacgtaagggtcgggtacccagtccgtaggttcaaggtcggcgtagtcgacacgttcgaggggaacagtaacttaccacttactactaacttacncgacgctaacgtcctagaccacggtacccttaggtaaacgtttactttttacggaactttaaactttttaacgttaccgtttaggtaaaccctaaacgttaacgtttaaacgtttaacctttaacccggttaaaccccccgtttagggttaccgggtttaaccccgggtttaccgggaaccccggggttaaagggggtaaccccggttaaagggggttaaccggtaaaacccggttaacccggtaaaacccgggtaacggtttaccgggtaccgggttcccgttaccggtaaacccccg

SEQ ID NO: 215044 - DNA, 742 bp, Homo sapiens
  misc_feature: GYAE6OF01DR4T0.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatccaattgacccagtctccatccctcctgtctgcatctaattggagacagacgtccaccatccacgttcggccggggacgacgtcgacggccatcgaagcgtattcgtttacgccgttggttgctagcaacgaaccgagggccgacgcccctacgaagtacttacggtacgtctagtcggtacgcactaccgagtagttcggacgtaacggggtcgggtaccctacgtccgtacggttacgaggttcgggactaggtcgtacgtacgtacggtacgggaactaggtaacttaacgtacttaccgtactaactacgtacgtaacgtaccgaccgtcgtaccgaccgtaacgtaccgttacggtaaagtttacgttttacgtaaacttaagtttttaacttacgttacggttaactaaacgttaacgtttaacgtttacgttaaacccggttacccgttaacgggtacgggttaacccgggttaccgggtaacccgggtaaacggggtaaaccggtaacggggttaacggtaaacggttaacccggaaaccgggttaactacgggttacggcccgttacggtaaaccccg

SEQ ID NO: 215045 - DNA, 707 bp, Homo sapiens
  misc_feature: GYAE6OF01CCVYK.1.34.D01.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (312)..(312): a, c, t, g, unknown or other
  misc_feature (312)..(312): n is a, c, g, or t
  modified_base (496)..(496): a, c, t, g, unknown or other
  misc_feature (496)..(496): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgaatctatgganacagatcacatcacgttgccgggcagtcaggccatcagcgtattctttagccgtggttncagacaacggaaaaccgngggccgacgcccctagacgtacttcgtagtctagtcggtncactccgagtactcgacgtaagggtcgggtaccagtccgtaagggttccgaggttcggactaggtcgtcgtaagttccggtacggggaactaacggttaaccttaaccgctttaccctacgtaacttaccgacgtaacgcctaaccgtccgtaccgacgtcgtaaccgttagtaaacggttttnttttaccgtaaacgtttaactttttactaaccgttaggttaaccctaaacgttaagtttaactttaaccggttaacccgttaaccccggttagggttaccggtaacccgggtttccggtaacccgggtaaacggggtaacccgtaaaggggttcgtaaacgtaacccggaaacccgttagtacggttgggacccttacggaccttaacccg

SEQ ID NO: 215046 - DNA, 825 bp, Homo sapiens
  misc_feature: GYAE6OF01DX2F7.1.34.D01.1.454.CMB.1.raw
  modified_base (229)..(229): a, c, t, g, unknown or other
  misc_feature (229)..(229): n is a, c, g, or t
tcagacgagtgcgtcacgaccggtgctcgatttagatcgtctgtggttggggtttgggggagtcagaccctgtcaggacacagcatggacatgacgggtccccgctcagctccgtggggctcctgctgctcgtcggcctcccaggtaccagctgtcgactactaccaattcgaccctagtcctccactccctccctgtctgctattctagtggagacagacgtaccacntacgtccgttggcccgggagacgtacgacggaccactacgaggtacgttactttcgttaggccttgggtacaccacggtacgaaacggaaacccggcgggggaccaccccggtaccccgttacgaaaggttcgtttaaccggtacttaccggttaggtccgggtacacgtaaccttaccggtaagttacggtaccggaaccgggtaacgggggttacccggtccctaaaggttcccggtaaacgggttcgaacgggttgggaccgtaggtaccgaccgttaaggtccgggaggtaacacgtaacctaaccgtccttacctacgtacttacgaccgtaagcgtaaccgtcgtactacggtaaccgtaggttaacggttactttacggttaacttaacggttttaaactttaccttaaccgtaggtaaacccttaaggttaaccgtttaaattacccgggttaaacccgtacccggttaaccggggtaggttaccccgggtacgggtaacccgggtaaaggggaccggtttaaacggaacgggttaacccggtaaaccgtaaacggtaccggttaggcggttacccgaggttaacccg

SEQ ID NO: 215047 - DNA, 619 bp, Homo sapiens
  misc_feature: GYAE6OF01CMI1D.1.34.D01.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatcctccctgtctgcatctattgganacagatccaccatcacgttcggccgggcgagtcgaggccatcgagcgtatttctttacgccttggttgcagcaacgaaaccgagggccgaccgcccctanagtctacggtatctagtgggtcncactccagtagttcgacgtaaggggtcgggtaccctagtcccgtaggttcgaggtcggctagtgacagtcgtagggaactaggtaacttaccacttctacgtaacctagtcaacgccgtacgtccgtcgacgtacgtccgtaagtaagtttactttacgtactttaaattttaacgtaccttagtaactaacgttaatttacttacgttacccgtacccggtacggtacggtacgtaccgggccgaaaggggtaccaaggggtacgtaacgtacccgtaacgtaggtgacgcgtcgac

SEQ ID NO: 215048 - DNA, 829 bp, Homo sapiens
  misc_feature: GYAE6OF01AWMG6.1.34.D01.1.454.CMB.1.raw
  modified_base (215)..(215): a, c, t, g, unknown or other
  misc_feature (215)..(215): n is a, c, g, or t
  modified_base (818)..(818): a, c, t, g, unknown or other
  misc_feature (818)..(818): n is a, c, g, or t
tcagacgagtgcgtcacgaccggtgctcgatttagatcgtctgtgttgggtttgggggagtcagaccctgtcaggacacagcatggacatggacgggtccccgctcagcctccgtggggctcctgctgctctcggcctcccaggtaccagctgtgacactacctaattcgaccctagtcctcctactccctcccgtgtctgctattctagtgganacgagacgtccactactccgtacgttcgggcccgggtacgacggtacgacggcctagtccgaaggtccgttaatttccgtttacgtccgttgggtcacgagaccgaaacggaaccggcgggaccgacccgtccccgtagtacgtacgttaccggttacgttacgtacgttggtcgtacctacgtaccgtaagtcggttacggacgggtacggggtccggtcctaacggtcggtacggttcgacgggttcggactaggtcgtacgtacggtacggtaacgggactaacgttaacctacctaccgtacttacctaaccgtactacgtaccgactacccggtctaccggtaccgtaaccgttacggttaagttaacgttttcgtttaaacgttaacttttaaccgtttaacgttacgtttaacgttaaccgtaaacggtttacgtttaacccgttaacccggttacccggttaaccccggtttaggggttaccccgggtacggttaacccggggaccggggtaaaccggggtaaccgttaacggggggaaacccgttaaacgaaccccgggttaaaacggttcggttacccggggtagttacccgnggttacccccg

SEQ ID NO: 215049 - DNA, 725 bp, Homo sapiens
  misc_feature: GYAE6OF01A3VWO.1.34.D01.1.454.CMB.1.raw
  modified_base (102)..(102): a, c, t, g, unknown or other
  misc_feature (102)..(102): n is a, c, g, or t
  modified_base (143)..(143): a, c, t, g, unknown or other
  misc_feature (143)..(143): n is a, c, g, or t
  modified_base (228)..(228): a, c, t, g, unknown or other
  misc_feature (228)..(228): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccngctgtgacatccaattcgacccagtctccactccctcctgtctgctatctagttggagacagacgtccacatcacttcggccggngagtcacggccatcgagcgtatttcgttacgccgttggtcgcaacgcgaacgaaaccgngggccgacgtcccctagaggtactcggttaagtcgtagtcggtcgctaattcccgaaggttacgttcggaacggtaacgggggtccgggtacccacgttaccggtaacggttcgaacgggttcggaccgtaggttccggactacggtacggtacggggaacttaacgtaacgtttaaccctacttacgtacctaacttaccgtacgaacgcgtaccgtccgtgaccgacggtacctaggttaagttacgtttacgtaacgttaattttacgtaactacgttaaccgtaacgttaagttaacttaacgtaaccgttaccccgtaaggtcccgggttaaccgttaccggggaaccggtaaccggggtaaccgtaaacggggttacggaaaccgttaacccgtaaaccggttaggtacggtacggtaccgtcggtaaaccc

SEQ ID NO: 215050 - DNA, 544 bp, Homo sapiens
  misc_feature: GYAE6OF01E0S2V.1.34.D01.1.454.CMB.1.raw
  modified_base (223)..(223): a, c, t, g, unknown or other
  misc_feature (223)..(223): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (394)..(394): a, c, t, g, unknown or other
  misc_feature (394)..(394): n is a, c, g, or t
  modified_base (539)..(539): a, c, t, g, unknown or other
  misc_feature (539)..(539): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctatggagacagagtcaccatcacttggccgggnagtcaggccatcgagcgtatttcttagccttggttgcagacaagaaaccgagggccgacgcccctnagtatcgtagtctagtggncactccaagtattggacgaaggggtcgggtacccaagtccgaggttcaggtgacgtagtcgactagtcgtagggacagtactaccnctctactactatcagccagctagcacgtctagaagttatttgacttaatttatacgtgtacaatattattataaccgtacccgtagttcggacgttcggaccgagggaacgtagggtacgacgtaccgtaacgtacgtagtgtcngtacc

SEQ ID NO: 215051 - DNA, 712 bp, Homo sapiens
  misc_feature: GYAE6OF01DDKSL.1.34.D01.1.454.CMB.1.raw
  modified_base (235)..(235): a, c, t, g, unknown or other
  misc_feature (235)..(235): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccgaggtaccagctgtgacatccaattcgacccagtcctccactcctccctgtctgcattctagttggagacagacgtccaccatcacgttcggccgggnagtcgaggccatcgagtcgtactttctttacggcgttggttgacacgacgaacggaaaccgacggggccgaccgccccctagagtacgttcgtagttctagttggtcgactactaccgagtacgttcggacgtaacggggttccgggtacccagttacccgtaggttacgaggttcggacgtaggtcgtactacgttcggtagggtaactagtaaccttacctaccgttactacctaacgttacgtacgaacgacacgtcccgtgtaccgacgtaccgttaagtaacgtttacgttttacgaatttaaacttttacttacgtacgttaacctaagttacgtttaactttaccgtaacccggttaaccccgttaggtaccgggttaccgggtaccggaaaccgggtacggggaaaccgtaagggtaacgggtaaacccgtaccggtaacggtacggttcggtaacggcgtacgtaccc

SEQ ID NO: 215052 - DNA, 806 bp, Homo sapiens
  misc_feature: GYAE6OF01E40GZ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccgaggtaccagctgtgacatccaattcgaccagtcctccactcctcctgtctgcatctagtcggagacagacgtacacctattctacgttcgggacccggggcgtacgtaccgaacggtccagttaccgacgtcgttaacgttttcgtttacggtccgttgggttaccgcgaacgaccgaacggaaaccggcggggaccgaccggtccccagtagtacgttcgtagttcgtagtcggtctactacgtcgagttagtcggacggtaacggggtcggtacctacgtaccgtaggttcgacggttcgtacgtagtacgtactacggttcggtaacgggtactaagttaaccgttaccctacgttcgtaacttaacgttacggtaccacggtaccgttaaccggcgttaccggtaccgtaacgggttacgtttaaggttaacgttttaactttacgtaaactttttaagttttaacccgtacgttaacgttaacttaaaacgttaacgttttaacgttaacccgttaacccggttaacccgggttagggttacccgggtaaccgggtttaccgggaacccgggtaaacggggttaaaccggtaacggggtttacggaaacccttaaaccgggtaacccgttacgggtttacgggcggtaacccgtcgtaaccccg

SEQ ID NO: 215053 - DNA, 764 bp, Homo sapiens
  misc_feature: GYAE6OF01CG05E.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtggggcctcctgctgctctggctcccaggtaccagctgtgacatccaattcgacccagtctccatccctccctgtctgcattcgtatggagacagagtcaccatccacgttcggcccgggcgagtccgacggccatcgacgtcgtatttccgtttagccgttgggttcgcgacgacgaacggaaaccggacggggaccgaaccgccccctagaacggtactccggttaacgttccgtaggttcgggtcgcctaacgtacccgtaagtacgttacggacggtaacgggggttccgggtaccctacgtcccggtaaggtttaccgagggttacgggacgtacggttacgaccgttaagtcgggtaacgggaacgtacggttaacctttaccctaaccttacccgttacttaaaccgttagtccgaacggtccaccggtcccgtaggacccgtaacggtacccgttaaggtaactttcgttttacgtacttttaaagtttcttaccgagttaacctaaagtttacgttattaacccgttacccggttaccgtacgggtacccggttaccgggttaccgggaccggtaaaccggggtaaccggttaagggtaacggtaacccgaccgtaaacggtcgttagggtccgcttacggacc

SEQ ID NO: 215054 - DNA, 612 bp, Homo sapiens
  misc_feature: GYAE6OF01ASSLO.1.34.D01.1.454.CMB.1.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttcgcagcaagaaaccgngggcacgcccctnagatcgtagtctagtggtgacactccagtattgacgtaagggtcgggtcctatccgaggttcagtgcagtgcagtcgtgggaactagtattacgactcctacactatcgagcacgccgtcgcgacgtacctaggaagtttgtttacgacttaagttttaacttaccgtataccgtaacttaaggttaactttacgtaacccggttacccttagggtaccggtacccggtttaccgggaccgggtaacggggtaacccggtaagggttaaccggtaaacggtaaccctaaaccgggttacgtacgggtacggtaccgtccggaacccg

SEQ ID NO: 215055 - DNA, 511 bp, Homo sapiens
  misc_feature: GYAE6OF01D8MV1.1.34.D01.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtncatccagattgacaagggtcgggtccatccaggttcagtggcagtgcatcgtgggacagattacactctcactatcagcagcctgacagcctagaagtatttgactaatttatactagtacaatagtattatacgtaccctagtggtacgttacggccgtaggggacctaagggtacggaaagtaccgaaaccgaactggtcggtcgtgtacc

SEQ ID NO: 215056 - DNA, 699 bp, Homo sapiens
  misc_feature: GYAE6OF01AWGWS.1.34.D01.1.454.CMB.1.raw
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaaccgngggccgacgcccctnagatcgtagtctagtggtgcatccagattggacgtaagggtcgggtccccagtcccgtagggttccaagggttcggctaggtgcgagttcggtagggaacaggtaactttaccacttcctactaacgttactaccgacgccgacgtcctgaccgtacggccttaggtaaagtttacttttacgaacctttaaactttttaactttaccgtacgttaacctaaacgtaagtttaactttaacgttaacccgtttaacccccgttaacggttaccgggttaaccggtttcccggggaaccggtaaccgggggttaaccgaaggggttacgggaaacgttaccgaaacccggtaaccggttgggttcgtaccgtaccggaccgttaacccgtagtttccgttacgtttacccttacctaccgtttccccgttccccggtacccg

SEQ ID NO: 215057 - DNA, 526 bp, Homo sapiens
  misc_feature: GYAE6OF01C1Q0X.1.34.D01.1.454.CMB.1.raw
  modified_base (197)..(197): a, c, t, g, unknown or other
  misc_feature (197)..(197): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (355)..(355): a, c, t, g, unknown or other
  misc_feature (355)..(355): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccggcgagtcaggccatcagcgattcttagcctggttgcagcagaaaccngggccagcccctanagatcgtagtctatggtcgcatccagtattgacgtaagggtcgggcccaatccgaggttcaggtgcagtgcatcngggacagtatacactctacaactatcaagcagcctgcagcctagaagtattttagactaaattttatacgttgtactaaactagttattacgtaacgtacccctagtcggtaccgttcggaccgaggggactaagggtagaacgtccgaaacgaacttggacgtctgaccc

SEQ ID NO: 215058 - DNA, 722 bp, Homo sapiens
  misc_feature: GYAE6OF01BUWWT.1.34.D01.1.454.CMB.1.raw
  modified_base (435)..(435): a, c, t, g, unknown or other
  misc_feature (435)..(435): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
  modified_base (553)..(553): a, c, t, g, unknown or other
  misc_feature (553)..(553): n is a, c, g, or t
tcagacgagtgcgtcacgaccggtgctcgatttagatcgtctgtggttggggtttgggggagtcagaccctgtcaggacacagcatggacatggacgggtccccgctcagctcgtggggctcctgctgctcgtggcctcccaggtaccagctgtagacatacccgaatcgaccctagtcctacctactccctccctgtctgctatctagtggagacgagactcactgtcacgtcggccggatcgtcgacgcaatccgaggtcttacgtttcgttacgtccgttaggtgaccaaggaccgaacggaaaccggcgggaccgtacccgacccctgacgtacgtacgtagtcttaggtcggacgctactcgtaagtcgttaggacggtacggggtccggtacctacggtacgtacggtagtaacggtgtacgtaacggngtacaaggttcgggacaatacgttactaccgtactctaacacgttancctacggacncgggttcaccggagcccgtaagtagttaaacgttttcgtacttaacgtttaatttacccgngtttaacctaaccgtaatttaacggttaactacccggttaccgtaccccggttagaaccccggttagggcccggtaagggttaacccgggaataaacccgggggttcggaaaacccttaaaccggacggggtttacccggtaagtacccggttccgaaagtaaaccccg

SEQ ID NO: 215059 - DNA, 744 bp, Homo sapiens
  misc_feature: GYAE6OF01EVWY6.1.34.D01.1.454.CMB.1.raw
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgaccagtctccatccctccctgtctgcatctagttggagacagacgtcaccatcacgttcggccgggtcgacgtcgaggccaagtccgagtcgtactttacctttacggcccttgggttcncaagacgaaacggaaacccgagggccgacgtcccccgngaacgtacgtccggttacgtctaagtgggtcactactccgtagtagtttcggacgtaacggggttccggggaccctagtacccgtacggttcgaagggttcggacgtaaggttcgaccgtaacgtcgggttaaggggaacctaacgggttaacctttaaccgtacccttaccttacctaaccgttaagtaccgtacggtaccacccggttaccgtcggacccgttaaccgccgttaacggtaaacttttaaccggttttgtaaactttaactttaactttacgtataaccgttaactttaacgttatttacccgttaaccgtaccccggttacggtaccgggttaccgtccgggaaccggtaagggtaccggtaaggtaccggtacgtaacccgtaaacggtcgtaaggttcgccgtggtaaccg

SEQ ID NO: 215060 - DNA, 611 bp, Homo sapiens
  misc_feature: GYAE6OF01EYDUD.1.34.D01.1.454.CMB.1.raw
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (465)..(465): a, c, t, g, unknown or other
  misc_feature (465)..(465): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagacgtcaccatcacttggccgggcgagtcaggccatcagcgatttctttagcctggttgcagcaagaaaccgngggcgacgcccctnagtatcgtagtctagtggtcncatccagtactgacgtagggtcggtcccagtccgtaggttcgaggtcggcgtaggtcgcgtagtcgtagggaactaagtaacttaccgtacttctactaacttactacgacgcctaaccgcctagaccacgtaccgtagtaaactttcgttttanaactttaattttatactacgtaactaacttaagttacttaacgtaccgtacccgttacggtcggtaaccggttccgggacggaacgggtaaccgtaagggtacgtaaacgtaaccgtaaaccggtacggtggtcggtcgtcggacc

SEQ ID NO: 215061 - DNA, 822 bp, Homo sapiens
  misc_feature: GYAE6OF01B491P.1.34.D01.1.454.CMB.1.raw
  modified_base (102)..(102): a, c, t, g, unknown or other
  misc_feature (102)..(102): n is a, c, g, or t
  modified_base (148)..(148): a, c, t, g, unknown or other
  misc_feature (148)..(148): n is a, c, g, or t
  modified_base (387)..(387): a, c, t, g, unknown or other
  misc_feature (387)..(387): n is a, c, g, or t
tcagacgagtgcgtcacgaccggtgctcgatttagatcgtctgtgttgggtttgggggagtcagaccctgtcaggacacagcatggacatgagggtccccgntcagctcgtgggctcctgctgctctggctccaggtaccagctggtnacactaccaattcgaccctagtcctaccactccctcccgtgtcctgctacttctagttggaacgagagacgtccaactactaccgtacgttcggaccgggacgtaacgtccgacggacccagtcgagtaccgtacttttccgtttacggccgttggttacgcgtaacgacgaaacggaaccggacgggaccgaccgtaccccctagaacgtacgttacgtacgttcgtaacgtggtacncgtactacgagttatacggaacggtacggtccgggtacctaacgttacgtaacggttccgaggttacggcgtaacggttaccggacgttacggttaaccggtacggggtaaaacctaagggtttaaccgtttaaaccctaccggttttaacccgaacccttaaaacggtttaccctaaacgtaaccgggaacctaccggtacccgttacggaacccggttaccgtaaccgtttaggtaaaacgttttcgtttaacgttaacttttaaacgtttaacgtttactaagttaaaccctaaagttagttaaaccgttaccgttaaccggttaccccgtaggtttacggacccggttaacgggaccggtaaacgggggactaacggggttaacggaacctaaccgtacccggttaagtaggtccgacgttaccgaacccg

SEQ ID NO: 215062 - DNA, 399 bp, Homo sapiens
  misc_feature: GYAE6OF01CO2IA.1.34.D01.1.454.CMB.1.raw
  modified_base (348)..(348): a, c, t, g, unknown or other
  misc_feature (348)..(348): n is a, c, g, or t
  modified_base (388)..(389): a, c, t, g, unknown or other
  misc_feature (388)..(389): n is a, c, g, or t
  modified_base (391)..(399): a, c, t, g, unknown or other
  misc_feature (391)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaacagtattatacgtacccctacgtggacgttcggccaggggaccaaggtggaatcaacgactgtgctgcaccatctgtcttcactccttccccgccctccncacgcacctcgtctggacgcgggctggcaaggcgcagtgnngnnnnnnnnn

SEQ ID NO: 215063 - DNA, 597 bp, Homo sapiens
  misc_feature: GYAE6OF01EAU7B.1.34.D01.1.454.CMB.1.raw
  modified_base (286)..(286): a, c, t, g, unknown or other
  misc_feature (286)..(286): n is a, c, g, or t
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgctagcaagaaaccgagggcgacgcccctnagatcgtagtctagtggtgacatccagtattggcgtaagggtgggtaccccagtcccgtaggtcaggtcggcagtcgctacgtcgtgggacagtacttacactctcactatcgaancacgtcctggccgagtaccgtagtaagtattttacggacttaaattttactacttagtacaaacttagttaacttacgtaacgttacccccgttaggtcgggtaccgttccgggaccggtaaggggtaccgtaaaggggtacggtaaaccgtaccgtaaaccggtaaacgtgggtacggtccgtacggtaacccg

SEQ ID NO: 215064 - DNA, 748 bp, Homo sapiens
  misc_feature: GYAE6OF01A1P3U.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcgagtcgacggccatcagcgtattctttagcctggttgctagcaacgaaaccgagggccgacgcccctcgagtactcgtagtctagtggtcgcatccgaagtagttcgacgtaaggggtcggtcccagtccgaggttcgaggttcggacgtaggtcgacgtattcggtagggaactaaggttacttaaccgaccttcctaccgttaactaacgttaccgaaggtcccaacggtccctaggacccgtaacggtacccgttaaggtaaacgtttacgtttttaacggaaccttttaaaattttttacggttaacccgttagtaaaaccgtaaaacgtttaacgtttaaacgttttaaaccggttaaccccgggttaaaccccctttaacgggggttccgggttaacccgggtttaccgggggaccccgggtaaaccgggggtaaaccgttaaacgggggtaacggtaaaccgttaacccgtaaaacccgggttagttacggggtaaccggtcccgtaacggtaccccg

SEQ ID NO: 215065 - DNA, 798 bp, Homo sapiens
  misc_feature: GYAE6OF01DMORT.1.34.D01.1.454.CMB.1.raw
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctgtggctcccgaggtaccagtctgtgactataccaattcgaccagtctccatccctccctgtcgtgcagttcgtattggagacagagtccaccatcacttggccggcgacgtcgacggccagtcagtcgtactttcttacgtccgttggttcncgaagacgaacggaaaccggcgggaccgaccggtccccctagaacggtacgttcggttaaggttccgttaggttcgggtactacgtacttaccgtagtagttcgacggtaacggggttcgggtaccctacgttacgtaggttacgacggtcgacgtaggtcgtacgtagtcggttaggaaccgtagtacttaccgacttacctacctaacgtacctacgaagtcgtaccgctacgtaccgtacgtacccgttaagtaaacggttttattttaacggtaacttttaaacgtttttaacttaacggttaacgttaaaccgttaaagtttaaccggttttaaactttaacccggtttacccgttaaaacccccggttcgggttaccgggggttaaaccggtttcccgggggtaaacccggaaacggggggttaacccggaaaggggttaaccgggtaaaccggttaaacccggtaaacccgggttaaacgttcggggtaaccggtaccggttcggaaccccgg

SEQ ID NO: 215066 - DNA, 783 bp, Homo sapiens
  misc_feature: GYAE6OF01EFW2G.1.34.D01.1.454.CMB.1.raw
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggcctcctgctgctctggctcccaggtaccagctgtgacatccaattcgacccagtctccatccctcctgtctcgcattctagtggaagacaggactaccacctactcgtacgttcggccgggacgacgtccgaggccagtcgacgtcgtatttccgtttacggcccggttgacaacgacaacggaaaccgngggaccgaccgtccctagagtacgtacggtacgtcgtaggtggtacgactactacgagtacgttcggacggtaacggggtcgggtaccctaggttaccgtacggttacgagggtcggacgtacggtcaccgtagtacgggtacgggtaactaacggtaactttaaccgacctttaccgtactaactaacgtacgacgaccgtaccggtcccgtagtacccgtaacgttacgtaacggtaagttttacgtttacgttaacttttaaacgttttacttaccgtacggttaaacctaaagtttaacgtttaacgtttaaccgttaacccggttaccccggttaagggttaccggttaaccgggtacccgggtaacggggtaaaccggggtaaaccgggtaacgggtaacgggtaaacccgtaacccggtaaaaccggtacggttacgggaaccgttacggtccgtaacccgttaaccgg

SEQ ID NO: 215067 - DNA, 739 bp, Homo sapiens
  misc_feature: GYAE6OF01CIIKU.1.34.D01.1.454.CMB.1.raw
  modified_base (173)..(173): a, c, t, g, unknown or other
  misc_feature (173)..(173): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtcctccatccctccctgtctgcatctatgganacagagtcaccatcacgttcggccgggcgagtcaggccatcagcgtattctttagccttggtgcagcaacgaaaccgaggggccgtacgcccctcgagacttcggtagtctagtggtacgctactccgagtagttggacgtaagggtcgggtacccagtcccgtaggttacaggtcggctaggtcgacgtacgttcgtaggggactacggtaacttacctaaccttcgtaacctacttaacgtccgtaacggaccgtaaccgtcccgtacggtaccgaacggttacccgttaaacgggtaaacgtttacgtttttacggaaacctttaaatttttaaccgtttaacctacgtaacctaaacgttaacgtttaactttaaccgttaaccgttaacccccgttaagggttcggttacccggttaccgggacccggtaaggggaaccgttaagggtaacgggtaaacgtaccgtaaaaccggtaggttacgggtcggtacctaccggtacctacccgtagttccgttaccgttaccgttacctacccgtttcccctccccccgttaccc

SEQ ID NO: 215068 - DNA, 391 bp, Homo sapiens
  misc_feature: GYAE6OF01B5IMA.1.34.D01.1.454.CMB.1.raw
  modified_base (380)..(380): a, c, t, g, unknown or other
  misc_feature (380)..(380): n is a, c, g, or t
  modified_base (386)..(391): a, c, t, g, unknown or other
  misc_feature (386)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcacgcctgcagcctagaagtattttgactaatttattactgtcaacagtattatagtacccctagtggacgttcggccaggggaccaaggtgaagtcaacgactgtaggctgcaccatctgtcttcatcctcccgcctcctcaccgctactcgtctgagcggctggcaggcncatagnnnnnn

SEQ ID NO: 215069 - DNA, 797 bp, Homo sapiens
  misc_feature: GYAE6OF01AUARR.1.34.D01.1.454.CMB.1.raw
tcagacgagtgcgtcacgaccggtgctcgatttagatcgtctgtgttgggtttgggagtcagaccctgtcaggacacagcatggacatgagggtccccgctcagctcctggggctcctgctgctctggctcccaggtaccagctgtgacatccaattgacccagtcctccatccctccctgtctgcatctattggacgacagacgtcaccactcacttcggccggggcgagtcaggccatcagtcgtattcgtttacggccgttgggttgccagaccgaacggaaacccgacgggggaccgaccgccccctacgagactacggtacgttccgtaaggttggtcggactacgtcccgaaggtacgttaggaccggtaacgggggttccggggttacccctacgttcccggtacgggtttacggacgggtcgggcgtaacggtcgtacgtcgttaccggtacgggggaacctaacggtaaccttactacccttccgtaacctaacgtacgtaccgagtccgaaccggtcccgtaggaccgaccggtacccggttaaggtaaacgtttaggtttttacggtaacttttaacgtttttaacgtttaacggttaacgttaaccgttaaaccgttaagtttaaaccgtttaaccgttaacccggttaaccccggtacgggttaaccggggtacccgggtttaccgggacccggggtaaggggtaaccggtaaggggttaccggggtaaaccgtaacccggtaaaccggtacggttacggtaccgggtcgtaccgggtaacccg

SEQ ID NO: 215070 - DNA, 605 bp, Homo sapiens
  misc_feature: GYAE6OF01ELBS8.1.34.D01.1.454.CMB.1.raw
  modified_base (100)..(100): a, c, t, g, unknown or other
  misc_feature (100)..(100): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
  modified_base (453)..(453): a, c, t, g, unknown or other
  misc_feature (453)..(453): n is a, c, g, or t
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
  modified_base (546)..(546): a, c, t, g, unknown or other
  misc_feature (546)..(546): n is a, c, g, or t
tcagacgagtgcgtcacgaccggtgctcgatttagatcgtctgtgttgggttggggagtcagaccctgtcaggacacagcatggacatgagggtcccccngtcagctccgtgggctcctgctgctcgtggcctcccgaggtaccagctgtagacatccaaattcgacccagtcctccactccctccctgtctgcatctatganacagatcacatcacgtggccgngatcgagccatcagtcgttaatttccttagccgtggttcgacacgtacaacggaaaccgngggaccaccgtcccctanagtacttcgtacgtcgtagtggtanacctactcgaagtctcggtacgtaaggtccggtacctagtccgtagtacgagtcggtacngtcagtacttacggnggaatacgtattaccacttctacgtactacggtacacgcacgtctcgacngtaccgtagtagttntactacgttaatttanacggtctaacctagtacttactagtaaccccgtgtaaccggtcgttaccggcgtaacccggngggtaaaccctaaggggataacccggaacctaacggtacgtgtacgtcgtaccgtaccg

SEQ ID NO: 215071 - DNA, 770 bp, Homo sapiens
  misc_feature: GYAE6OF01E3R27.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtctccatccctccctgtctgctatctagtggagacagagtcaccatccacgttcggccgggcgagtcgaggccatcgaggtcgtacttttccgttacgtcccgttgggttacgccaaggaccaaacggaaacccggagggggaccccgaccgtcccccgttagaaggtacttaccggtagttcctaggttggtcgactactaccgtagtcgtttacggacggtaacggggtcgggtacccctaacgtccggtaggttcgagggtcggtacagggttgaccgttacggtcggtaacggggaacttacgggtaacttaccctaccgttcccgttacgtaaccttacggtaccgaggtacctacggtcccgtacggtaccgtaaccgtacgtaaggttaacgttttctttaacgtaaccgtttaattttaaccgttagttacgtaaccttaaacgttaactttaacgttacccgttaacccggtttaacccgtagggttaccggtaccgggttacccgggaccgggtaacgggggtaacccgttaaagggtaccggaaccgttaaccggtaacccggtacgttagggtccgtcgtaccgtaacccg

SEQ ID NO: 215072 - DNA, 806 bp, Homo sapiens
  misc_feature: GYAE6OF01B8OJQ.1.34.D01.1.454.CMB.1.raw
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattcgacccagtcctccactccctccctgtctgctatctagttggagacagacgtccaccactccgacgttcggcccggggacgacgtccacggccatcgagcgttaattttccgtttacgtccgttggttcgacacggaccgaacggaaacccggacggggaccgaccggcccctagagtacgtcgtacgtcgtagtggtcactacgtccgaagtcgttacggacggtaaggggttccgggtacctacggttcccgtagggttcgtacgggtcgggacgttacggtcgtacgttacggttcggtaacggggtaactaacgggtttaacctttaaacccacccgtttacctaaccgttaaccgttaccgtaacgacggtaccgtaccggttacccgtacgaccgtaaccgttaccggttaaggttaacggttttacgttttaccgtaacttttaaacgtttttaccgtaacgtttacggttaaaccctaaagtttaacgtttaaccgttaacctttaaccccgggttaacccgttacggggttaccggttacccgggttaccgggaacgggtaacccgggtaacggtaacgggtaccggtaacgtaacccggtaaacgtacggttacggacggtccgtaacggtaccc

SEQ ID NO: 215073 - DNA, 751 bp, Homo sapiens
  misc_feature: GYAE6OF01EULYZ.1.34.D01.1.454.CMB.1.raw
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaaccatcacgttcggccggggtcgagtcgaggcccatcgagcgtattctttagccgtggttgcagcaaggaaaccgagggaccgacgcccctagagagtcgtagtcgtagtggtnacactccagtattcggacgtaaggggtcgggtaccagtaccgtaggtcgtaaggtcggacgagtcgactagtcggtacggggactaacggtacttaaccgtaccttccgtacctaacgttactacgtaacggcgtaaccgtcccgtagacccgtaacgtacccggttaaggtaaacgttttagttttaccgaacgttttaaaacttttttaacgttaccgtttaacgttaaaccgtaaacgtttaaggtttaaacttaaaccggtttaacccggtaaaccccggtttacgggttaaccgggttaacccgggtttaacccgggaccgggtaaaccgggggtaacccggtaaacggggttaacgggaaaacccgttaaacccggtaaaacccggtaacggtttaacgggtcgggttaaccgtcgtaaaccccgg

SEQ ID NO: 215074 - DNA, 796 bp, Homo sapiens
  misc_feature: GYAE6OF01AK4Y4.1.34.D01.1.454.CMB.1.raw
  modified_base (104)..(104): a, c, t, g, unknown or other
  misc_feature (104)..(104): n is a, c, g, or t
  modified_base (206)..(206): a, c, t, g, unknown or other
  misc_feature (206)..(206): n is a, c, g, or t
tcagacgagtgcgtcacgaccggtgctcgatttagatcgtctgtgttggggtttgggggagtcagaccctgtcaggacacagcatggacatgacgggtccccgntcagctccgtggggatcctgctgctcgtggctcccaggtaccagctgtgacataccaattcgacccagtcctccactccctccctgtctgctatctatgganacagagtccacctatcaccggtcggaccgggcgtaggtccacggcctatcgagtccgttacttccgtttacgccgttggtacgacacggaccaacgggaaacccggcgggtccaccgcccctagaagtactacgtagttacgtagtcggcgactaactaccgtaggtacgttcggaacggttaacgggggtccgggtaccctacggtacccgtaggtttaccgtaacgggtcgtaccgtaggggtctacccgtaggtacccggtaacgggtaactaaggtaacctttaacccgaccttacgtaacctaacctacgtaccgacggtacgtacccgccggtacgacgtaccgtacgtaagtaagtttacgtttacttaaactttattttaacaccggttttacaaacgtttaacgttaatttaaccggtaaccgtaacccggttacccggttaggtaaacccgggttacgggttaaaccccgggaacgggggttaaaccgggaaaccggtaaacggtttaaccgggaaaccgttaaaccccggtaaacccgtaggttaccccgggttaagacccccggttaaggtaaccccg

SEQ ID NO: 215075 - DNA, 641 bp, Homo sapiens
  misc_feature: GYAE6OF01A8L9P.1.34.D01.1.454.CMB.1.raw
  modified_base (235)..(235): a, c, t, g, unknown or other
  misc_feature (235)..(235): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (537)..(537): a, c, t, g, unknown or other
  misc_feature (537)..(537): n is a, c, g, or t
tcagacgagtgcgtcacgaccggtgctcgatttagatcgtctgtgttggggtttgggggagtcagaccctgtcaggacacagcatggacatgacgggtccccgctcagctccgtgggctcctgctgctctggcctcccgaggtaccagctgtcgactatccaattcgaccctagtctccactcctcctgtctgcattctagtgacgacagacgtcacatcacgttacggccgggngagtccgacggccatcagtcgtacttacttacgccgtggttacgactacgacgaacggaaaccggacgggccgaccgccccgtagacggtagtcgtagtctagtcgggcactactaccagtagttcggacggtaagggtccggtacctagtccgacggttacgacggtggtacgtacggtgactagtcggaggactacgtacttacactcgtacaacgtanacgacncgtacgtcctagcgtacgtcgtaagtagtttacgtttaccaagtttaactttacttacgacggttaccaaagttntaaacttcgtaaccgtaccctggtaccggttacgtccggtaggtaaccgggtacgtaacggtacggtaacctaccgtaaacgtacggtgttacggctgtaaccc

SEQ ID NO: 215076 - DNA, 641 bp, Homo sapiens
  misc_feature: GYAE6OF01CJGF9.1.34.D01.1.454.CMB.1.raw
  modified_base (278)..(278): a, c, t, g, unknown or other
  misc_feature (278)..(278): n is a, c, g, or t
  modified_base (633)..(633): a, c, t, g, unknown or other
  misc_feature (633)..(633): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctatggagacagagtcaccatcacgttggccgggcgagtcacggccatcagcgtattcgtttagcctggttgcagcaaggaaaccgngggccgacgcccctacagtactcgtagtctagtggtcacgtactccgagtattcggacgtaacggggttcgggtaccccagtcccgtaaggttcgaggtcggactaggtcgactagtcgtagggaactagtacttaaccacgttccactactactacgacgacctacgccctgaccgtacgtaccgtaagttaacgtttgtttaactaacttttaacgtttacgtttacgtacgttaactaagttattaaccttacgtacccgttaccggtacggtacggtacccgggtacggaccggggaacgggtacggtaaagggtacgtaaccgaccgtaaaccggtggtacgacgtccgngtaacccg

SEQ ID NO: 215077 - DNA, 626 bp, Homo sapiens
  misc_feature: GYAE6OF01CHX3E.1.34.D01.1.454.CMB.1.raw
  modified_base (209)..(209): a, c, t, g, unknown or other
  misc_feature (209)..(209): n is a, c, g, or t
  modified_base (577)..(577): a, c, t, g, unknown or other
  misc_feature (577)..(577): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (593)..(594): a, c, t, g, unknown or other
  misc_feature (593)..(594): n is a, c, g, or t
  modified_base (598)..(598): a, c, t, g, unknown or other
  misc_feature (598)..(598): n is a, c, g, or t
  modified_base (600)..(604): a, c, t, g, unknown or other
  misc_feature (600)..(604): n is a, c, g, or t
  modified_base (606)..(625): a, c, t, g, unknown or other
  misc_feature (606)..(625): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagtattgcaagggtcggggtcccatccaggttcaggtggcagtgcatcgtgggacagattacactctcaatntcagcagctgcacgctagagtattttgactaattttacttactgtaccaataagttaacttaacgtaccgtaacccccgtggtaccggtacggttaccgggaccgaacgggggtaaccaacgggtaggaaacgtaccgaaaccgtaagtggtacggcctacggactaacctacgttgttaccgttaccttccgtaacctttcccccgtttcccccggtaccccctttacccgtacccgtaaccggtacccccttaacggtttccccggttaccgtacggggtaacccgggtcccggggggttaccgttacccgggggaaaccgtaccgggggacccgtaacgtaaaacgttacgggcagtacacgtcnctcgtcacacncangnncgcncnnnnncnnnnnnnnnnnnnnnnnnnna

SEQ ID NO: 215078 - DNA, 757 bp, Homo sapiens
  misc_feature: GYAE6OF01BBCOK.1.34.D01.1.454.CMB.1.raw
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattcgaccagtcctccactccctccctgtctgctatctagtgagacagagtcaccatcacgttcggccgggtcgagtcacggaccatcgagcgtacttcgttacgccgtggttcgcagacaacggaaaccgagggccgacgcccccgtagacgtacgtacgtacggtctacgtcggtctacgtaactacgaagtacgttaggaacgtacgggggtaccggtaccctacgtaccggtaggtaccgtaggtcgtacgtagtcgtactacggtcggtaagggactagtacttaacctacgtctaacattaacgtcaagaccncggtcccgtagccgaacggtccttagggtaaactttacgtttacgactttaaagttttaaccgttacgttacgttaaacctaaacttaacgtttaacgttaaccgttaccccgttaaacccgggttaccggtacggggttaaaccccgggttccggggaaaaccccggtaacgggggttaaaacccggtaaccgggggttaaacggaaacccgggtttaaacccgtaaacccccggggttagttaaccggggttaccgttacggtacccgtaaaccccgg

SEQ ID NO: 215079 - DNA, 549 bp, Homo sapiens
  misc_feature: GYAE6OF01APYOK.1.34.D01.1.454.CMB.1.raw
  modified_base (519)..(519): a, c, t, g, unknown or other
  misc_feature (519)..(519): n is a, c, g, or t
  modified_base (521)..(524): a, c, t, g, unknown or other
  misc_feature (521)..(524): n is a, c, g, or t
  modified_base (526)..(549): a, c, t, g, unknown or other
  misc_feature (526)..(549): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagtattacactctcaactatcagcacgcctgaccacgtcctaggaagttagtttttgacttaattttacttaactcggtacaacgtagttaatttactaaccggtaccccttaggtcgggtaccggttccggaccggaagggggtaaccaagggttacgggaaacgtaccgaaaccggtaaccgtgggtcggtactcggacccaaccgtatttccgtacgtttccttactaaccttccccttcccccctaccccgtccctaccgaccgtacctacccgttccggtcgtaggaccggccgggtactcgggaccgaacgggcacgaagtagcncnnnncnnnnnnnnnnnnnnnnnnnnnnnn

SEQ ID NO: 215080 - DNA, 746 bp, Homo sapiens
  misc_feature: GYAE6OF01B3R1L.1.34.D01.1.454.CMB.1.raw
tcagacgagtgcgtcacgaccggtgctcgatttagatcgtctgtggttggggtttgggggagtcagaccctgtcaggacacagcatggacatggacgggtcccccgctcagctccgtggggctcctgctgctcgtggcctcccgaggtaccagctgtgacatcctaattcgaccctagtcctccatccctccctgtctgcctattcgtagtggagacagacgtcacctatcacgttcggccgggtacgagtccgaacggctaactcggaacgtcgtaacgttttccgtttacggtccgttgggttcgaccgtacggaccgaaacgggaaaacccggtcggggaccggaacccgaccccccgtagtaaacggacgtttaccgggtaagttaccgttaaggtggggtacaccttaacgacccgtaggtactttacgggacgtaaaggggtccgggttcccaaatcccggtaaggtcctagggtcgcgtaatgactacgttggacggaacagtactacacttccactacttacgacgcgtacgacgcctgtacacgtcgattaagttattagtacttaacttagttacgtacgtaactaacgtttagttaagttaccgtaaccggttaccgttaacgttccgggtaaccgggtttaccgggacccggtaacggggtaaccgggtaggtaccgggaaacggttaacccggtaaacggttaccgtacgggggtactccggtaccgtaaccg

SEQ ID NO: 215081 - DNA, 1012 bp, Homo sapiens
  misc_feature: GYAE6OF01B4SP9.1.34.D01.1.454.CMB.1.raw
tcagacgagtgcgtcacgaccggtgctcgatttagatcgtctgtgttgggggttgggggagtcacgaccctgtcaggacacgagcatggaacagtcgagggtccccgcgtccaggcctccgtcggggcctccgtggcctggctctcggcctcccgagggtaccacggctcgtacgactatccaagttcgacccagtcctccactcctcctcgtctcgctatctagtggacgtactagtacgtacaaccgtatacacgttcggccgggtacgtacgtcgacgggcctatcgacggtcgtactttacgtttacgccgttagggttctaccggacgaccgtaaacggaaacccggacggggtaccgtaacccggtaccccgtaccggtaaaggttaccgttaaccgggtttaacgttcccgttaaaggtcggggtttaaccaccgttaacccgtacccggttaacggttaacgtttcccgggtaaccgggttaaaccgggggttcccggggtaacccccctaaagggtttaccccccggttaaaggggggttttcccaacccggggggtttacggggaaccgttacgggggtttaaacccggtaccgggtttaaacggttccccggggttaaacggggggaaccccttaaaaaggggttcccttttaacccggtaacccgtttacctaaccgtttaacccgttaacgtcccggaaaccgtcccggtaaccggtaaccgtccgggtaccctagggtaacccttaagggtaaacgttttaccgttttaaacggtaacctttaacggtttttaaccttaaacggtttacgtaaaccgtttaaaacgttacgttttaaaccttaaccggtaccccggtttaaccccggtttagggttaaaccccgggttccgggttaacccgggaaacccggggttagggggaaaccccgttaggggttaaacgtaacggtaccccgtaaacgggttacgttacggggtacctcggtaccggtaacccg

SEQ ID NO: 215082 - DNA, 538 bp, Homo sapiens
  misc_feature: GYAE6OF01D9AEB.1.34.D01.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
  modified_base (532)..(532): a, c, t, g, unknown or other
  misc_feature (532)..(532): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattcgacccagtctccatcctccctgtctgcatctatgganacagatcacatcacttgccggcagtcaggccatcgagcgtattcgtttagccgttggttgcgagccaaggaaaccgagggccacgcccctnagtactcgtagtctagtggncatccagtattgcgtaaggtcgggtcccagtcccgtaggttcaggttcggctaggtgctagtcgtcgggaacngttaacttaccactctacgacttagtcgacgcgacgcctgccagcctagattatttgacttaagttctatagtacaagtatattactacgtaccctaggtcgtcgttacggccgaagggtactaggtaggactacgaaccgtacgtgtacgntggacc

SEQ ID NO: 215083 - DNA, 495 bp, Homo sapiens
  misc_feature: GYAE6OF01CZI73.1.34.D01.1.454.CMB.1.raw
  modified_base (132)..(132): a, c, t, g, unknown or other
  misc_feature (132)..(132): n is a, c, g, or t
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (465)..(495): a, c, t, g, unknown or other
  misc_feature (465)..(495): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtncatccagattgcaagggtgggtcccatccgaggttcagtggacngtcgcatcgtgggacngattacactctcactatcagcagcctgcagtcctagagtattttgactaatttattactgttaccaatagttacttaagtaccgtaccctacggtacggtaccgttcggaccgaggggacccaaggtgaacggtacaaccgtagtggtcggctgaccgactatctacgtcttcacgtcccttcccgcccttcacgtacgccttacgtcgtcgtaggcgaccgggtctcgggaacgaacggtcgaccagtanctgacctgcagnactgntcagnnnnnnnnnnnnnnnnnnnnnnnnnnnnnnn

SEQ ID NO: 215084 - DNA, 654 bp, Homo sapiens
  misc_feature: GYAE6OF01AUGQQ.1.34.D01.1.454.CMB.1.raw
  modified_base (244)..(244): a, c, t, g, unknown or other
  misc_feature (244)..(244): n is a, c, g, or t
  modified_base (443)..(443): a, c, t, g, unknown or other
  misc_feature (443)..(443): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctagttggagactagagtcaccatcacttgccggcagtcaggccatcagcgattcttagcctggttgcagcagaaaacccngggtccgagcccctgagtactcggtagtccgtagtggtgcctatccaagtattgacgaagggtcgggtacccagtccgaaggttcagtggctaggtcgacactcggtacgggaactagtacttaacaccgtctacgtaaccttagtccgaaacgtcaaccggtccgttaggacccgtagtacccttaggtaaaacgttnttttacgaactttaattttaaccgttacgtagtaacctaacgttaagttactttaacgttaaccgttccccgttaagggtcggttaaccggttaccggaaccggaaggggtaccctagggtacggaactccgtaaaccgtaccgtggtacggtctacggcctacccgtagttccgtacggttcctacctaccttcccgttccccgtccccg

SEQ ID NO: 215085 - DNA, 672 bp, Homo sapiens
  misc_feature: GYAE6OF01CCWTG.1.34.D01.1.454.CMB.1.raw
  modified_base (104)..(104): a, c, t, g, unknown or other
  misc_feature (104)..(104): n is a, c, g, or t
  modified_base (421)..(421): a, c, t, g, unknown or other
  misc_feature (421)..(421): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggggagtcagaccctgtcaggacacagcatggacatggacgggtccccgntcagctcgtggggctctgctgctcgtggctcccgaggtaccagctgtgacatccaattcgacccagtcctccatccctcctgtctgcatctagtggagacagagtcaccatcgacgttggccgggcgaggtcacgggcccaagtccgaagtcgtaatttcgtttacggccttggggttcaccaggaccaaaggaaacccggaggggacgacccgtaccccagagtactaccggttagtcgttagtcggtcacaactccgagtagttcggaacggtaggggtcggtaccctaagtcccggtaagttcgaaggttcggnacgtgactagtcggtagggaactacgtattacgactntacctaagtactcgaancgacgttccngacgacgtacgtaagtaacgtttatttcgaactttaattttacgtacgtacgtaactaaatagtttaacaacgttaaccggttacccggtaggtccggggtaacgttcccggggaacgggtaagggggaaccgtaaaggtaccgggtaaataaccgggtaaacgaacggttgccggtagaccgtacg

SEQ ID NO: 215086 - DNA, 764 bp, Homo sapiens
  misc_feature: GYAE6OF01EV5ER.1.34.D01.1.454.CMB.1.raw
  modified_base (572)..(572): a, c, t, g, unknown or other
  misc_feature (572)..(572): n is a, c, g, or t
  modified_base (728)..(728): a, c, t, g, unknown or other
  misc_feature (728)..(728): n is a, c, g, or t
  modified_base (748)..(748): a, c, t, g, unknown or other
  misc_feature (748)..(748): n is a, c, g, or t
tcagacgagtgcgtcacgaccggtgctcgatttagatcgtctgtgttggggtttgggggagtcagaccctgtcaggacacagcatggacatgacgggtccccgctcagctccgtggggcctcctgctgctcgtggcctcccgaggtaccagctggtgactactacctaaacttcgaccctagtccctcctactcccttccctgtctcgctatcgttagttacggaacgacctagtacgtaccaaccactaccgtaccggttcgggccggggtaccggacgtaccggacggtacctagtaccgacggttaccttaacgtttttaccgtttacggacccggtttgggttcgacaacggtacaaaccgggaaacccggcggggacccgtacccgtccccagaacggtacgttcggtacgttacgtagtcgggtacactacgtacgtagtaggtacgacgggtacggggtccggtaccctagtccggtagttcggaacggtcgcgtagacgtactacggtacggaggtaactacgttacctacctacctctactactagacgactacgacgtaccngtaccgacggtacttaaggttaactttacgtttactaactttaacttttacgtacgtacttaacggttaaactttactttaacgtaccgttaaccgtacccggtacggttaccgggtacccggtagggaacccgggtaaggtaccggtaagggtanaaccggtaactaaccgggtntacggtctagccgtac

SEQ ID NO: 215087 - DNA, 843 bp, Homo sapiens
  misc_feature: GYAE6OF01DG8M8.1.34.D01.1.454.CMB.1.raw
  modified_base (609)..(609): a, c, t, g, unknown or other
  misc_feature (609)..(609): n is a, c, g, or t
tcagacgagtgcgtcacgaccggtgctcgatttagatcgtctgtgttgggtttgggggagtcagaccctgtcaggacacagcagtggacatggacgggtccccgctcagctccgtgggcctcctgctgctcgtcggcctacccgaggtaccagtctgtcgacctactacctaagttccgaccctagtcctccctacttcccttcccgtgtctgctacttcttaggttaggaacgtacgaggtacgtaccaacctacttacctacggttccgggcccggggtacgtacggtccgacggaccctagtcgacggtccgtttacgttttaccgtttacggtccggtttgggttcgaccgaacggaaccggaaaccgggaaaccgggcggggaccccggaacccgtccccgtaacgaaggtaccggttacggttacgttccgtaggttcgggtctacctacttaccggtaagtacgttacgggaacggttacgggggttccgggtacccctacggttcccggttaagggttcgaagggtcggacgtacggtcgaccgttaggtccgggtaagggaactaggttaacttcctaccttctaactacttacgtaccncgacgtccgtcggcgtaccggacctacgttagggttaacttacggttttacacgtttttaaactttacgtaacgttccgtaaacgtaaagtttacgtttaacttaccggttaaccccgttaaccggttaccggtacggggtaaccgttcccgggaacgggtaacccgggtaacggttagggtaaccggtaacggtaacccgtaacggttacggtcgttcgtaccgtcccgaacg

SEQ ID NO: 215088 - DNA, 775 bp, Homo sapiens
  misc_feature: GYAE6OF01AP4NN.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctctggctcccgaggtaccagctgtgacatccaattcgacccagtctccatccctcctgtctagctattctagttggacgacgagacgtccaacactcgacgttcggaccgggcgagtcacggccagtcgacgtcgttactttcgttacgccgttggtacgacgtacgacgaaacggtaaaccggacggggacccgtaccgtacccccgtagaacgtacggttaccggttaggttaccgttaaggtcgggtacgtaccgtaacgtaccgtaacggttaagtttaccgggaaccggttaacgggggttcccgggtaccctacgtacccgggtaggttacccgagggttcggacgtacgtcgacgttacgtacggtacgggaactagtaccttaccgacttactactactataccgacggtcgtaccgccgtacgaacgaccgtcgttaagtacgtttacgttacgtaactttaaagttaccgttaccgtaagttaaccgtaacttagttaaccttaaccggtacccgttacccggttaggtaacccggggtaccgtaccgggaaccggtaacgggtaaacggtacgggttaacccggaacggttaaccccgaacggtttcggacggggtactccgttaacccggtaccg

SEQ ID NO: 215089 - DNA, 674 bp, Homo sapiens
  misc_feature: GYAE6OF01AXVEL.1.34.D01.1.454.CMB.1.raw
  modified_base (294)..(294): a, c, t, g, unknown or other
  misc_feature (294)..(294): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattggagacagagtcacatcacttcggccgggcgagtcaggccatcgagcgtattctttagccgtggttgctagcaaggaaaccgagggaccgacgcccctanacgtactcgtagtctagtggtcgcactcgagtatggacgtagggtcggtacctacgtccgtacggttcagtggactaggtcgacgacgttcggacgggtacaggttacttaacctactccgtacactactacgacgtcacgcctagaccgacgtaccttaggaaagtttacttttcgaactttaagtttttaaccttacggtacgttaacctaaacgtttacgttaaacgtttactaaacccgggttaccccgttagggtaccgggttaaccccgggttaccgggaacccgggtaaacgggggtaacctaacggggggtaacgttaaaccggtaccgtaaaacccggtacgttcgggtacgtcccgtaaacggtaccccg

SEQ ID NO: 215090 - DNA, 781 bp, Homo sapiens
  misc_feature: GYAE6OF01BA0MW.1.34.D01.1.454.CMB.1.raw
  modified_base (210)..(210): a, c, t, g, unknown or other
  misc_feature (210)..(210): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggcctcccaggtaccagctgtgacactccaattcgacccagtcctccacttccctccctgtctgcctattctagttgganacagtacgtccactatcctacggttcggccgggacgacgtccgacggtcccaactcgacgtacgttacgttttaccgttacggtcccgttaggttcgacacggacgaaacggaaaccgacggggaccaaccggtcccctagacgtacgttcggttaacgttcgtacggtggtcacctacgtacgtaagtccgttacgggaacggtacggggttccggtaccctagttccggtaggttacgaggtcgacgtagtcacgtagtccggacggactacgtacttaccgtacgtccgtactacgttacacgacgtaccgccggtactaccgaccgtaccggtacctaagggttaccttttacggttttaccgaactttttaacgtttaacccggttaacctttcgggtaaaccttaacggtttaacggtttaacgtttacccggtaacccggtttaaccccggtagggttaccgggttacccccggtaagggtaccccgggttaaggggacccggttaaaggaccgggtacctaaccgggttaaccgtacggttacgggacggtactcgggtaccc

SEQ ID NO: 215091 - DNA, 741 bp, Homo sapiens
  misc_feature: GYAE6OF01DUBPA.1.34.D01.1.454.CMB.1.raw
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccgaggtaccagctgtgacatccaattgacccagtctccatcctccctgtctgcattctattggagacagagtcaccatctacgttggccgggcgagtcaggccatcagcgtatttcttacgccttggttcgcagcaacgaaaccgngggccgacgcccctnagacttcgtagtctagtggtnctatccagagttgacggtaagggtccgggtaccctacgttcccgtaaggtttcgaacgggttcggaccgtaaggtcgtactaacggttaccggtaggggtaacctaagtaactttaacccgtaccttccgtaactaacgttacttacgaacgtaccgaacggtccctacggaccgtaacggtccttaaggtaaactttgttttacgaacctttaaatttttacgttaacttacggttaacctaaacgttagtttaaaccgtttaagttaaccccggttaacccgttaaggttacccggggttaaccggtttacccggggaaccccggtaaaggggggttaacccgtaaacgggggttaacgggtaaaacggtacccgtaaaacccgggtaacggtttcggggtaccgtacgtaccggtaaccccg

SEQ ID NO: 215092 - DNA, 733 bp, Homo sapiens
  misc_feature: GYAE6OF01DBEC2.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccgaggtaccagctgtgacatccaattgacccagtctccatcctcctgtctgcatctagttggagacagagtccacctatcacgttcggccgggcagtcgacggccatcagtcgtactttctttacggccgttggttcgacgacggcgaaacggaaaccgacggggccgaaccggtcccctagagtacgtcggtagtacctaggttaggcgacgtactacctaagtaacgtggacggtaacggggttcggtaccccgtagttaccggtacggttacgtacgggttacggacgtacgggtacgactacggtttacgacggggtaacctaggttacttaaccgtcttacgtactaccgttagtaccacggaccacggtcccttaggaccgtaaccggttacgtaaggtaacgtttagtttttacgaacgttttaaagtttttacgtacctttacggtaacgtaacttaaggtttaactttacgtaaccggttaccccgttaacgggtcgttaaccggttaccggggaccggtaacggggtaaaccgttaggggtaacggtaactaccccgtaaagggttacgtggtaccgtgttccgaacccg

SEQ ID NO: 215093 - DNA, 421 bp, Homo sapiens
  misc_feature: GYAE6OF01BT04A.1.34.D01.1.454.CMB.1.raw
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
  modified_base (407)..(421): a, c, t, g, unknown or other
  misc_feature (407)..(421): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgactaatttattactgtacaactagtattactacgtacccctacggtcggtacgttccggacgacgggggaccaagggtggaacgtcgaaaccgactggnggctgcacatctgtctcatcctcccgcatctagaacncacgtcgtcngacggcggctggacgaaggccntagagnnnnnnnnnnnnnnn

SEQ ID NO: 215094 - DNA, 433 bp, Homo sapiens
  misc_feature: GYAE6OF01CNRPC.1.34.D01.1.454.CMB.1.raw
  modified_base (322)..(322): a, c, t, g, unknown or other
  misc_feature (322)..(322): n is a, c, g, or t
  modified_base (409)..(409): a, c, t, g, unknown or other
  misc_feature (409)..(409): n is a, c, g, or t
  modified_base (411)..(433): a, c, t, g, unknown or other
  misc_feature (411)..(433): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtgggtcccatccaggttcagtggcagtgcatcgtgggacagatacactctcactatcagcagcctgcagcctagaatatttgactaatttattactgtacaatagttattactacgtacccctagtggtacgttcggccgaggggaccaagggtcgaagtccaaccgactggngctgacacatctgtctctactctcccgctatcagaaccgtcacgttcgtcgtaggcggcgggactgggacaaggcgactagtagcangnnnnnnnnnnnnnnnnnnnnnnn

SEQ ID NO: 215095 - DNA, 663 bp, Homo sapiens
  misc_feature: GYAE6OF01AFVOT.1.34.D01.1.454.CMB.1.raw
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacgttcggccgggcgagtcaggccatcagcgtattctttagccgtggttcgcagacaacgaaaccgnggggaccgacgccccctgagatcgtagtctagtggtgcatccagtagttgacggtagggtcgggtcccagtccgtaggttcaggtcggcgtagtgactagtcgtagggaacaggtaacttaccgacttccgtactaccgttatacgacggaccaccgccgttcgaccgtaccgtaccgtaagggtaaacgtttacgttttaacgtaacttttaagttttaacctttacgtacgttaacctaaacttaggtttaaccttaacgttaacccggttacccgtacgggttaccgggtaccggttcccgggaccggtaaggggtaacccgtaaggggtacggtaaccgttaaccggaaaccggttacgtacgggtcgtcgttaccgaccg

SEQ ID NO: 215096 - DNA, 682 bp, Homo sapiens
  misc_feature: GYAE6OF01EEYN6.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctatggagacagacgtcaccatcacgttcggccgggcgagtccgacggccatcgagcgtatttctttagcccgttggttgcagacaaggaaaccgaggggccgaccgccccctagagtacgttcggtagttctagtgggtcgactacgtccaagtagttcgacgtaacgggtcgggtacccctagtaccgtaggttcaggtcggacgtaggtcgactagtccggtagggactaggtacttaccaccttactctaacttcacgacgacgacgtcctcggacgtacgtaccgtagtaacgtttattttacgaactttaagttttactacgtacgttaactaaacgttagttaacttaccgtaaccggttaaccccttagggtaccgggttaacccggttaccgggtacccgggtaaagggggtaacccgtaaggggttaaccggaaaccgtaaccggtaaaccggtacgttacgggtcgtaccgtcggtaacccg

SEQ ID NO: 215097 - DNA, 802 bp, Homo sapiens
  misc_feature: GYAE6OF01BV8GI.1.34.D01.1.454.CMB.1.raw
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattgacccagtctccatcctcctgtctgcatctatggagacagagtcaccatcaacgttggccgggnagtcaggccaatcagcgattcttagctggtgcagcaagaaccgagggacgacgcccctanacgtatcgtagtcgtagtggtcncatccagtattaggacgtaaggggtcgggtaccagtccgtaggttcaggtggctaggtcagtacgtcgtagggacaagtacttaccgtactacttacgaacttactacgacgaccgtaacggtccctaggaccgtaacggtacccgttaagggttaaaacggtttactttttaacgggtaaaccttttaaaacgtttttaacgttttaaacccggttaacggttaaacccgttaaaaacgtttaaacggttttaaaacgttttaaaccgtttaaaacccccgggtttaacccccggtttaaacggggtttaacccggggttaaaccccggggttttaaccccggggggaacccggggttaaaaacccgggggggggttaaacccgggttaaaaacgggggttaaaccgggggtaaaacccgttaaaacccggttaaaacccggggttaaaccgtttacgggttaaccgggttaccggttaccggtaaaaccccg

SEQ ID NO: 215098 - DNA, 703 bp, Homo sapiens
  misc_feature: GYAE6OF01BYNK5.1.34.D01.1.454.CMB.1.raw
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattcggagacagagtcaccatcacttcggccgggcgacgtcaggccatcgagcgtatttctttagccttggtcgcagcaacgaaccgngggacgacgcccctnagactcgtagtctagtggtcnctacgtccgaagtcttacggacgtaacggggttccgggtacccctaagtacccggtagggtttacgaacgggttcggacgtaggtcgacgtagttccggtaacggggaactaacggttaaccgttaacctaccgttccttaccctaacgttactacgtaacggtacctaaccgtcccgtacgaccgtaaccgtacccgtaggtaaacgtttgtttttaacggacttttaaattttaaccttacgttacgtaactaaacgtagttaacttaacgttaccgttaaccccgttaggtccggtaccggttccgggaaccggtaaggggtaaccctaaggggtacgtaaccggtaaccgtaaaccggtacggttaggacggtccgtcggtaaccc

SEQ ID NO: 215099 - DNA, 674 bp, Homo sapiens
  misc_feature: GYAE6OF01DW2A9.1.34.D01.1.454.CMB.1.raw
  modified_base (102)..(102): a, c, t, g, unknown or other
  misc_feature (102)..(102): n is a, c, g, or t
  modified_base (199)..(199): a, c, t, g, unknown or other
  misc_feature (199)..(199): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattcgacccagtcctccatcctccctgtctgctatctattgganacagagtccactatcacttgccgggcagtcaggccatcagcgtattctttacgccttggtcgacagacaacgaaaaccgngggaccgaccgcccctacaggtagttaccggttagtacgttagtgggtcactaactaccgagtaacgttggacggtaaacggggttccgggttacccctagttaccccggtaggttacgtacgggtggtaccgaagttcggacgtacgtcggttacgggaactaggtaacttaaccctaccttactactactactacacgtacgacgtccgtgacgtacgtacgtagttaacgttagtttacgtactttaaagtttacttacgttaacgtacgttaacttaacgtttacttaacgtttaaccgtacccgttaggttaccggtacggttacccggaacggtaacgggacgtaaggtaacgacgtaacgtacgtaaacgtggacgtcgtcgtaaccg

SEQ ID NO: 215100 - DNA, 736 bp, Homo sapiens
  misc_feature: GYAE6OF01AHNES.1.34.D01.1.454.CMB.1.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcgagtcaggccatcagcgtattctttacgccttggttgcagcgaagaaaccgnggggcacgcccctnagctcgtagtctagtggtcgacactccgagtacgttggacgtaaggggtcgggtcccacgtccgtacggttcgtaaggtcgggactaggtcgacgtacgtcggtagggaactacggtactttaaccaccgttactacctaacgttactaccgaacgtaccgaaccggttcccgtaggtaccctaccggtaccgtttaaggtaacggttttactttttaaccggtaacttttaaacgttttttaacgtacctttaacgggtaaccttaaacgtttaacgtttaaacgtttaacccgttaacccggtttaccccgtagggtttacccggggtaccgggttacccgggaacccgggttaacgggggtaacggtaacggggtacgggttaaaaccgttacccgtaaaaccgggttacggttgggtaacgggttccgtaccggtaaaccccg

SEQ ID NO: 215101 - DNA, 676 bp, Homo sapiens
  misc_feature: GYAE6OF01CRIAU.1.34.D01.1.454.CMB.1.raw
  modified_base (440)..(440): a, c, t, g, unknown or other
  misc_feature (440)..(440): n is a, c, g, or t
  modified_base (646)..(646): a, c, t, g, unknown or other
  misc_feature (646)..(646): n is a, c, g, or t
  modified_base (666)..(666): a, c, t, g, unknown or other
  misc_feature (666)..(666): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctcgtggctcccaggtaccagctgtgacataccaaattcgacccagtcctcccactcccttccctgtctgactattctagttggagaccaggactccaacctatcctacgttcggccgggacgagtccacggacatcgagctatttcgtttacgccgttggtcgacagacgaacgaaaccggcgggtcacccgtcccctacgaggtacttccggttagttccgtaagttgggtacacctacgttaccgagtagttcggacggtaacggggttccggaccctacgtcggtacgttacgaggtacggatacgggtcncgtacgtccggtagggtaacctagtaaccttaccgacttcgtaactagttacacgagtacccggtctcccgtaggtctaaccggtcgttaaagggttaacttttcgttaagtaaccttttaagtttaacgttaccgttagtacttaagtacgttacttaccgtaccggtacgttacggtggtaaccggtcgacggtacggtaacgngtaacgacctacggactagnggctgtcgac

SEQ ID NO: 215102 - DNA, 437 bp, Homo sapiens
  misc_feature: GYAE6OF01DQQV3.1.34.D01.1.454.CMB.1.raw
  modified_base (418)..(437): a, c, t, g, unknown or other
  misc_feature (418)..(437): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatcgtgggacagattacactctcactatcagcacgcctgcagcctagtaagtattttgactaaattttacttactgtacaactagttattatacgtaccctacgtggtacgttcggccgaggggaccaagggtgaagtcaaccgactggtgctgcaccatctgtcttcactcctcccgctatctacgaccgcacgtcgtctggacggcgggctacgggaccaagggtccgactaagtcgnnnnnnnnnnnnnnnnnnnn

SEQ ID NO: 215103 - DNA, 565 bp, Homo sapiens
  misc_feature: GYAE6OF01COWST.1.34.D01.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (445)..(445): a, c, t, g, unknown or other
  misc_feature (445)..(445): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaccatcacttggccgggcgagtcaggccatcagcgtattcttagcctggttgcagcaagaaaccgagggccgacgcccctnagactcgtagtctagtggtnctatcctagtacgttgacggaagggttcgggtacccagtcccgtaggttcaggtcggactaggtcgactagtcgtagggacagtacttaacacctactactactactcgagacacgtccagccacgtctagtaagttnttttacgaacttaacgtttattactagtactaactagttaacttacgtacgttacccgtagtccggtacgtcggcgaagggaaccagggtacgaactacgaacggtactagcgcgcgtac

SEQ ID NO: 215104 - DNA, 663 bp, Homo sapiens
  misc_feature: GYAE6OF01EA6XQ.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattcgacccagtctccatcctccctgtctgctatctagttggagacagagtccaccatcacgttggccgggcgagtcgagccatccagtcgtattcgtttagccgttggttcgaccgtagaccgaaacggaaaacccggacgggaccgtaccgtccccctacgaagtacgttaccggttagtaccgttaagttcgggtcgtactactacccgtaagtagttcggaccgtaacgggggtccgggttacccaagtcccggtaagggttccaagggttcggaccgtaggtcggacctagttcgggtaggaactaggtacttaaccacgttctaacactaatcacgtcaacgtccctgcctaacgtcgtagtaacgttatttagaacttaattttacttacgtacgttaactaagttattaacttacgtaaccgtaccctaggtacggtacggtcggacggaagggtactaagggtacgtataacccgaacgtacgtggtacgtcgtgaacc

SEQ ID NO: 215105 - DNA, 830 bp, Homo sapiens
  misc_feature: GYAE6OF01BA7SA.1.34.D01.1.454.CMB.1.raw
  modified_base (105)..(105): a, c, t, g, unknown or other
  misc_feature (105)..(105): n is a, c, g, or t
  modified_base (133)..(133): a, c, t, g, unknown or other
  misc_feature (133)..(133): n is a, c, g, or t
tcagacgagtgcgtcacgaccggtgctcgatttagatcgtctgtgttgggtttgggggagtcagaccctgtcaggacacagcatggacatggacgggtcccccgntcagcctccgtggggcctcctgctgctntcggctcccgaggtaccagtctgtgacataccaattcgacccagtcctcctactccctccctgtctgactatctagttggagacaggactaccacctatccgtacgttcgggaccgggacgaagtccgacggtaccaagtcacgtacggtactttccgtttagtcccgttagggtttcgaccgtaaggaccgaaacggaaaaccggtacggggaccgacccggtcccccgtacgacggtacgtaccggttaacgttacgttaggttcgggtacgtacacgtccaaggtacgtttagacggtaacggggtccgggttaccctaacggtcccgtagggttacgtacggtacggcgtagtcgacgttacgtacggtagggaactagggttaacttactaccgttctaaccgtaacttacgtaccgtaacgaccgtaaccggtcctaccggtcgttacgtaccggttagttaacgtttagtttaccgtaagtttaaaccttttaagtttaaccgtaacgttaacgtaaacgtttaagttttaaccgttaccggttaaccccgttaacccggttacggttaccgggtaacccgggtttccgggaacccgggtaccggggtaaaccgggtaggggttaacccggtaccggtaaaccggtaaccgggttacgttaggggaccgttaccggtccggtaaaccccg

SEQ ID NO: 215106 - DNA, 489 bp, Homo sapiens
  misc_feature: GYAE6OF01BGG9G.1.34.D01.1.454.CMB.1.raw
  modified_base (244)..(244): a, c, t, g, unknown or other
  misc_feature (244)..(244): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
  modified_base (448)..(472): a, c, t, g, unknown or other
  misc_feature (448)..(472): n is a, c, g, or t
  modified_base (474)..(474): a, c, t, g, unknown or other
  misc_feature (474)..(474): n is a, c, g, or t
  modified_base (476)..(489): a, c, t, g, unknown or other
  misc_feature (476)..(489): n is a, c, g, or t
tcagacgagtgcgtcacgaccggtgctcgatttagatcgtctgtggttgggtttgggagtccaggccatcagcgattctttagcctggttgcagcagaaaccagggcgagcccctcagatcgtagtctatggtgcatccaggtattgcaaggttgggggttcccagttcccaggttcagtggcagtgcatcgtggggacagtagttacactctcactatcgagcagcctgcacgcctagaagtnttttgactaattttacttacgtagtactaacgtagttattacgtacgtacccctaggtcggtaccgttcggaccgaggggaccaagggtcggaagtcgaaccgagtggtggctgaccacctagtcctgtcttacattcctcccgactatcgtacgaaccgcacgtctntcggacgtcgcgtggacaacggcgactatagntgannnnnnnnnnnnnnnnnnnnnnnnngngnnnnnnnnnnnnnn

SEQ ID NO: 215107 - DNA, 691 bp, Homo sapiens
  misc_feature: GYAE6OF01CWMUE.1.34.D01.1.454.CMB.1.raw
  modified_base (101)..(101): a, c, t, g, unknown or other
  misc_feature (101)..(101): n is a, c, g, or t
  modified_base (134)..(134): a, c, t, g, unknown or other
  misc_feature (134)..(134): n is a, c, g, or t
  modified_base (141)..(141): a, c, t, g, unknown or other
  misc_feature (141)..(141): n is a, c, g, or t
  modified_base (203)..(203): a, c, t, g, unknown or other
  misc_feature (203)..(203): n is a, c, g, or t
  modified_base (488)..(488): a, c, t, g, unknown or other
  misc_feature (488)..(488): n is a, c, g, or t
  modified_base (514)..(514): a, c, t, g, unknown or other
  misc_feature (514)..(514): n is a, c, g, or t
  modified_base (678)..(678): a, c, t, g, unknown or other
  misc_feature (678)..(678): n is a, c, g, or t
  modified_base (685)..(685): a, c, t, g, unknown or other
  misc_feature (685)..(685): n is a, c, g, or t
tcagacgagtgcgtcacgaccggtgctcgatttagatcgtctgtgttgggtttgggggagtcagaccctgtcaggacacagcatggacatgaggtccccgntcagctcctgggctcctgctgctctgcctcccnggtaccngctgtgacatccaattcgacccagtcctccattccctccctgtctcgctactctagttgganaccagaacgtcccaacctattccgtaccttggcccgggacgtagtccgacggaccctatccgaagtccgttacgtttcgtttaacgccgttggttcgacacggaacaaaccggaaaaccctacgggggcccgtaacccggccccctacgtaagtaccgttacggttacgttcgtaagtgggtacaccacgttaccgagttacgtaggtaccgaacggggtccggtaccacgtccgtaaggttcgagtcgacgagtcgatacgtcgaggactagtaaccgttaacnccgttacacgtacgtctacgagaccngcccgtcgcgtaacgtccgtaagtaacgtttctttaccgttaatttaaacgtttacgttaaccgtagttaaccctaataaccgtttaattaccgttaaccgttaacccgtggttaccggaccggtcgacggtaacggcgtaaaggtcgaacttacgaacgtagngttcggntcgacc

SEQ ID NO: 215108 - DNA, 594 bp, Homo sapiens
  misc_feature: GYAE6OF01B4A0R.1.34.D01.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (557)..(557): a, c, t, g, unknown or other
  misc_feature (557)..(557): n is a, c, g, or t
  modified_base (560)..(561): a, c, t, g, unknown or other
  misc_feature (560)..(561): n is a, c, g, or t
  modified_base (565)..(568): a, c, t, g, unknown or other
  misc_feature (565)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(577): a, c, t, g, unknown or other
  misc_feature (574)..(577): n is a, c, g, or t
  modified_base (579)..(591): a, c, t, g, unknown or other
  misc_feature (579)..(591): n is a, c, g, or t
  modified_base (593)..(594): a, c, t, g, unknown or other
  misc_feature (593)..(594): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcgaagggtcgggtcccatccgaggttcagtggcagtgcagtcgtgggacagtacttacactcgtcactatcagcagcctagcagctagaagtnttttgacttaatttntacgngtacaacgtagtattacgtacgtaccccgtagtcggtaccgttcggaccgtaacggggacctaagggtcgaaaccgttaaccgaaaccggtaacgttggttacggccgtacgacccaaaccgtagttccttacggtttccttaaccggaccttttacccgttcccccggtcccctttacctcccgaacccggtcctaaccgtttcggttccgtaggaccgggtaccggggtcgttaacgggacccggaaaacggggcccttaacgaaacggttagcgctagcgagngcgngngtgngtacgnacnngagnnnnangngnnnncnnnnnnnnnnnnngnn

SEQ ID NO: 215109 - DNA, 686 bp, Homo sapiens
  misc_feature: GYAE6OF01EWUSZ.1.34.D01.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (417)..(417): a, c, t, g, unknown or other
  misc_feature (417)..(417): n is a, c, g, or t
  modified_base (670)..(670): a, c, t, g, unknown or other
  misc_feature (670)..(670): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggngagtcaggccatcagcgtattcttagcctggtncagcaagaaaccgnggcgacgcccctagagtatcgtagtctagtggtgacactccgagtacgttggaccggtaaggggttccgggtaccccagttacccgtagggtttaccgaggttacggacctaaggttcgacgtaagtccgggtagggaactaacgtactttaccgacttctactaacttacncgaaggcctacgccttacgaccgtacggtaccttaaggtaaacgtttcttttacggaactttaagtttttacgtaaccttacgtaaaccttaacgtaagttttaacgtttaaccgttaacccggttaacccccgttagggtaccggtaccggtttccgggaaccggtacggggtaaccgtaagggtacggtaaccgtaccgtaaaaccggtacgttgggtcgactacggacctaacgtctcgttctaccttanaccgttccctccgtac

SEQ ID NO: 215110 - DNA, 767 bp, Homo sapiens
  misc_feature: GYAE6OF01DXOTL.1.34.D01.1.454.CMB.1.raw
  modified_base (153)..(153): a, c, t, g, unknown or other
  misc_feature (153)..(153): n is a, c, g, or t
  modified_base (203)..(203): a, c, t, g, unknown or other
  misc_feature (203)..(203): n is a, c, g, or t
tcagacgagtgcgtcacgaccggtgctcgatttagatcgtctgtgttgggtttgggggagtcagaccctgtcaggacacagcatggacatgagggtcccccgctcagctccgtggggcctcctgctgctcgtggctcccaggtaccagctgtnacataccaattcgacccagtctccactcctccctgtctgcatctatgganacagatccaccatcacgttcggccgggacgtacgtcgacggcccatcgagtacgtactttccgtttagcccgtgggttacacgaacgacaaacggaaaaccggacggggaccgaccggtccccctacgaaggtacgttacggtacgttaccgttagtgggtacgacctacgtacccgtaagtaacttacgggaccgtaaacggggggttcccgggtaaccccctacgtttacccggtaacgggtttaccggtaacgggttacggtacgtaacggttcgtaacccgttacggttaccgggttaaggggaaaaccccgtttaggttaaacgtttaaaccctacccgtttaaccccttacttaaaccgttacgttaaccgaaccggaccgaacccggtccgtacgtaccgacggtacccgtaagttaatttacgtttagtactttaaagttttacttacgttaacgtactaagtaattacgttacttaccgtacccttagtccggtacgtccggaaccggtagggaacgtaggaacgactaccgtaacgtacgtagcgcgtcgtaac

SEQ ID NO: 215111 - DNA, 625 bp, Homo sapiens
  misc_feature: GYAE6OF01A07TV.1.34.D01.1.454.CMB.1.raw
  modified_base (424)..(424): a, c, t, g, unknown or other
  misc_feature (424)..(424): n is a, c, g, or t
  modified_base (462)..(462): a, c, t, g, unknown or other
  misc_feature (462)..(462): n is a, c, g, or t
  modified_base (616)..(616): a, c, t, g, unknown or other
  misc_feature (616)..(616): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgctatctagttggagacagagtcaccatcacgttggccgggcgagtcacggccatcgagcgtatttcgtttagcctggttgcagacaagaaaccgagggccgacgcccctgagtactcgtagtctagtggtgacactccagtattacggacgtaaggggtccgggtaccctagtccgtaggttcaggtggactagtgactagtcgtagggactaggtacttacgaccttctacactacncacgaccgacgtccagccgtacgtaccgtagtaagttntttacgtactttaattttaactactagtactaacgttagttaacttacgttaaccgttacccgtaggtaccggtacccggttacggaccggtaacggggtaacctaagggtaccggtaaacgtaccggtaaaccgtacggttaggtaccggtcncggtacccg

SEQ ID NO: 215112 - DNA, 780 bp, Homo sapiens
  misc_feature: GYAE6OF01BYCHJ.1.34.D01.1.454.CMB.1.raw
tcagacgagtgcgtcacgaccggtgctcgatttagatcgtctgtggttggggtttgggggagtcagaccctgtcaggacacagcatggacatggacgggtcccccgctcagctccgtggggctcctgctgctctggctccgaggtaccagctgtgacataccaattcgacccagtctccactcctcctgtctgcattctagtggacacagacgtacacctatccacgttcggccgggtcgtacggtcacgggcctagtaccgaggtcgttaacttttccgtttacggtccgttaggttcgaccgaaggaccgaaaacgggaaaacccggacgggggacccgtaacccggtcccccctaggaacgttacgttaccggttaacgttccgttaaggttcggtacgactaacgttacccggtaaggttacgtttacgggaaccgggttaacgggggtccgggttaccctaacgtacccggtaggtttacgagggtcggtactaagggtccgtacgtacggttacggaacgggtaactaacgttaacttaccacttcctactaacgttacgaccgacggacctacgtccccgtaggaccgtacgtaccggttaagtaacgtttagttttacaacttttaaattttaccgttacgtacgtaacctaaagttatttaacttaacgtacccggttaccgtacgggtcggtaacccggttcgggaaccgaacggggtaacgtagggtacgtaaacgtaccggtaacgtacgtggtccgtcgtcggtacc

SEQ ID NO: 215113 - DNA, 664 bp, Homo sapiens
  misc_feature: GYAE6OF01CLGMJ.1.34.D01.1.454.CMB.1.raw
  modified_base (260)..(260): a, c, t, g, unknown or other
  misc_feature (260)..(260): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtcctccatcctccctgtctgcatctattggagacagagtcaccatcacgtgccgggcgagtcaggccatcagcgtattctttagcctggtgcagacagaaaccgagggccgacgcccctnagatcgtagtctatggtgcatccagtattcgacgtaagggtcgggtacccagtcccgtaaggttcgaggtcggacgagtgactatcggtgggaactaagtactttaaccacgtcctactactactcacgcacgtcctacgacgacgtccgtaggtaagttacgttttagaactttaagttttattaacgttacgtaacgtaaactaggtttaacttaacgttacgtttaaacccccgttagggtaccgggttaaccgggttcccggaccgggtaacggggtaacctaaggggtaacgtaacggtaccgaaaccggtaagttcggtacggtaccgtacgtacccgtaaccgtattccgttacggttacccgttactaacccgttcccctttacccccgtaccccg

SEQ ID NO: 215114 - DNA, 683 bp, Homo sapiens
  misc_feature: GYAE6OF01BW47H.1.34.D01.1.454.CMB.1.raw
  modified_base (177)..(177): a, c, t, g, unknown or other
  misc_feature (177)..(177): n is a, c, g, or t
  modified_base (475)..(475): a, c, t, g, unknown or other
  misc_feature (475)..(475): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtcctccatccctccctgtctgctatctagttgganacagacgtccacctatccacgttcggcccgggcgacgtcgaggccaatcaggtcgttatttccgtttacggccgttgggttcgaccgaggaccgtaaacggaaaacccggcggggaccgtaaccgtcccccgtagaacggtacgtttaccggttacgttcgttaggttgggtccacgtacgttaccgagtacgttcggacggtaacggggttccgggtaccctagtccggtaggtttcaggtcggcgtagtcgacgtagtcgtagggactagtacttaccacgttactacgtaactancgtaacgctacgtccgtacgcgtacgtcgtaagtaacgttatttacgtaactttaattttacgtaacgtcgtaactaacttaagttacttaccgtaccgttaccgtaggtccggtaacggtcggtacgacgggtaccgtaggtacgaacggtactaaccgtgcgtcggctacgctactgttccgtagttccactacctccctcccgtc

SEQ ID NO: 215115 - DNA, 746 bp, Homo sapiens
  misc_feature: GYAE6OF01CNEJ8.1.34.D01.1.454.CMB.1.raw
  modified_base (739)..(739): a, c, t, g, unknown or other
  misc_feature (739)..(739): n is a, c, g, or t
tcagacgagtgcgtcacgaccggtgctcgatttagatcgtctgtgttgggtttgggggagtcagaccctgtcaggacacagcatggacatgagggtccccgctcagctccgtggggcctcctgctgctcgtggctccccgaggtaccagctgtgacatccaattcgacccagtcctccactccctcccttgtctgcctatactagttggaagacagagtccaccatccacgttcgccgggcagtcacggccatccgagtcgtatttcgttacgcgttggtgactacggacaacggaaacccgaggggaccgaccggaccccccgttagaacggtaccgttacggttaacgttaccgttaaggttgggtacgtactaacgtaacccgtaagtaagttcggaacggtaacggggtccgggtaacccctaacgttcccggtaaggtttaccgaggttacgggacgtaaggtcgtacgtacgtcggtaagggaactacggttaaattaacccgtacttactaaccgtaacgtaactccggaaagacctaccggtccgtaacgaaccgtaacggtaccgtaaggttaaagtttcgttttaccgaatttttaaacttttacgtacgttaacgtactaaagttacttaacttacggtaacccgttaccggttacggttaaccggtcggttaccggacgggtaaccgggacgtaaggtacgtacgaacgtaaccgtagtgtaacggntaccgac

SEQ ID NO: 215116 - DNA, 763 bp, Homo sapiens
  misc_feature: GYAE6OF01B1JYY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccactccctcctgtctgctatctagttggagacagacgtcaccatcgacgttcggccgggcgagtcacggcctatcagcgtatttcttacggtccgttggtcgacgacgacaacggaaaccgagggaccgacgcccccgtagagtactacgttacgtacgtagtcgggtcgacgtacgtaccgaagtattcggacgtaaggggttccgggtacctacgtccgtaaggttcgtacgggtagggacgtacggcgtacgtcgtacgggacgtactaagttaccgtacgtaccgttactaacgtactacggtaacacggtactaccggttcgtacggtacctaccggtacgttaaggttaacgttttcgtttaacgtaaacttttaaccgttttaacgttacgttaacgttaaccgtaaacggttttaacgttaacggtttaaacccgttaacccggtttaaccgggttacgggttaaccggttaacccgggtaccgggtaaccgggggtaaaccgggtaacgggttaacggggtaaccgttaaaccggaacccggtaaacggttcgggttaacggcccggttacgccgtaaaccccgg

SEQ ID NO: 215117 - DNA, 518 bp, Homo sapiens
  misc_feature: GYAE6OF01A3Z71.1.34.D01.1.454.CMB.1.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggccgagcccctnagatcgtagtctatggtgcactccagtnttgacgaagggtcgggtccagtccaggttcaggtgcagtgcatcgtgggacagtatacactctacactatcagcagcctgcacgcctaggtaattntttacgattaatttatactgtacaatagttaacttactaacgtaccctaggtcggtaccgtcggaccggagggacctaagggtcggaatacgtaaccgagtggcgcgtgaccg

SEQ ID NO: 215118 - DNA, 508 bp, Homo sapiens
  misc_feature: GYAE6OF01CYXLQ.1.34.D01.1.454.CMB.1.raw
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (463)..(465): a, c, t, g, unknown or other
  misc_feature (463)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (479)..(481): a, c, t, g, unknown or other
  misc_feature (479)..(481): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (487)..(488): a, c, t, g, unknown or other
  misc_feature (487)..(488): n is a, c, g, or t
  modified_base (490)..(491): a, c, t, g, unknown or other
  misc_feature (490)..(491): n is a, c, g, or t
  modified_base (493)..(493): a, c, t, g, unknown or other
  misc_feature (493)..(493): n is a, c, g, or t
  modified_base (495)..(500): a, c, t, g, unknown or other
  misc_feature (495)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(508): a, c, t, g, unknown or other
  misc_feature (506)..(508): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccgagtattgcaagggttcgggtcccatccaggttcagtggcagtgcagtctgggacngattacnctctcactatcagcacgcctgaccncgcctgaagtattttgcttaatttactactgtacaactagttatttactacgttaacccctaggtggacgttcggccgagggggaccaaggtggaacgtccaaccggattggcggtcagcaaccntacctagtccttacacttccgttaccccgcccttcctnaccgcctacttgtcgaggacggcggcttggaccgtaacggcaccggaatacgggntacgntacgancntancgtnnnanancgcgcngngnnngncngnncnngngnnnnnncntncnnn

SEQ ID NO: 215119 - DNA, 792 bp, Homo sapiens
  misc_feature: GYAE6OF01ALGHR.1.34.D01.1.454.CMB.1.raw
  modified_base (604)..(604): a, c, t, g, unknown or other
  misc_feature (604)..(604): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacatcctaattcgacccagtcctcccattcccctcctgtctcgcattctagttggagacagacgtcacatctacgttcggccggcgagtcgacggcctatcaggtcgtactttcgtttacggccgttaggttccgacaacggtaaccaaacgggaacccggacgggggccccgtaaccggacccccttacgacgggtaacgtttaccgggttaggttacccttaaggttcggggtacaccccgaattaccccggtaaggttacgtttacgggaacggtaaccgggggggttaccccgggttacccctaacgggtttaacccgtggggtttaccggaggtttcgggacctaagggttccgactaaggttccgggtaacgggtaactcggtttaaactttccgaacctttacctacgttaaccttaacgtcgaaccggccgtacctcccgggtanccgggactacgtaaggttacgttacttttacgactttaaatttttaccgtacgtactaaccgtaattaaggttattaaccgtaccggttaacccggtgtaccggggtaccggtaccgggaccgggtaagggacttaaacggggtacgtaaccctaaccggtacgtacggttagggcccgctgaacccg

SEQ ID NO: 215120 - DNA, 674 bp, Homo sapiens
  misc_feature: GYAE6OF01A8PCJ.1.34.D01.1.454.CMB.1.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (396)..(396): a, c, t, g, unknown or other
  misc_feature (396)..(396): n is a, c, g, or t
  modified_base (489)..(489): a, c, t, g, unknown or other
  misc_feature (489)..(489): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctcgtggctcccaggtaccagctgtgacatccaattcgacccagtctccatcctccctgtctgcatctagttcggagacagtagtccaccagtctacgttcggccgggacgtagtcgacggccatcagcgtatttcgttagcctggtcgcagacacgaaacgngggcacgcccctnagtctcgtagtctagtggtcntactacgngtaagtcggaaggttacggggtcggacctacgtccgaggttaccggaggttcggactagggttccntaacggttcgggaacgggactaacggtaactttacacctttaccacgttaacctagtaccacgctacgactcgacacgtacgagttaacgttnttacgaactttaacgtttataccgtataaccgtaattactttaaacgtacccttaacccggttaacccgtacgggttacggttacccgggtaccgggtaaccgggaacggtttaacccggggaaggttaccgggtaaacgtacccgaaacccgggtacgtttcgggaggtacccgtcgtaacccg

SEQ ID NO: 215121 - DNA, 774 bp, Homo sapiens
  misc_feature: GYAE6OF01BL7RR.1.34.D01.1.454.CMB.1.raw
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctagttggagacagacgtcaccatcacgttcggccgggngacgtcacggcatcacgcgtattcttacgccttaggtcgcagacaagaaccgagggccacgcccctanacgtagtcgtagtctagtggtgctactcgagtacgttcgacggtaaggggtcggtaccctacgtaccgtacggttcgagtcgggtactagtacgctagtcggtagggaactaacgtactttaaccgccgttccctaataccttataccgacgaccgtaaccgtccgttacgaccgttacggtaccgttaacggttaaacggtttacgtttttaccgaactttttaaacgttttttaccaaccggtttaacgttaaacccttaaacggtttaaacttttaaccgtttaaaccgtttaaaccccgggttaacccccggttttaacggggttaccgggtttaaccggggtttaacccgggaaccccgggttaaaggggggtaaacccggttaaagggggtaaaccgggggaaaccttaaaccccgggtaaaaccgggttacggttaaccggggttcggtacccgttaacggtaaacccccg

SEQ ID NO: 215122 - DNA, 666 bp, Homo sapiens
  misc_feature: GYAE6OF01EK1YQ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaccaggggcgacgcccctcagatcgtagtctatggtgcatccaagctaagttgaccgaaagggttccggggacctactcgtaggttcaggtggacagtcgacgtatcggtaggacagtacgttacacgttctcctaacttactacgacgtacgacgtccgtcgacgaccgtccttaaggaaacgtttacgtttttacggaacctttaaagtttttactttaaaccgttacggttaacctaaacgtaaggttttaaactttaaaggttaaccgttaaaccccccgttaacggggtaaccggttaccgggtttccggaaccggggtaacgggggtaaacccgtaaggggtaacgggtaacgtaaccggtaaacccggtaaaccgttgggtaccgggtcgtacgg

SEQ ID NO: 215123 - DNA, 677 bp, Homo sapiens
  misc_feature: GYAE6OF01BVTY0.1.34.D01.1.454.CMB.1.raw
  modified_base (102)..(102): a, c, t, g, unknown or other
  misc_feature (102)..(102): n is a, c, g, or t
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatcccaattcgacccagtcctccatccctccctgtctgcatctatggagacagatcaccatcacgttgccgggngagtcaggccatcagcgtattcttagccttggtncagcaagaaacgnggcgacgcccctanagtntcgtagtctagtggcncatccaggtacttggacgtaagggtcgggtacccagtcccgtaggttacagggttcggacaggttcgactagttcggtacgggaacctaggtacttaaccgaccttctaccgaacttagtcccgaagccctaacggtccttacggacctacggtacccttaagggtaaactttacggtttactaacgtttaacttttaacgttacgtacggttaacctaaacgttagttaactttaccgtaaccggtaccccgttaaggttaccgggttaccggttaccgggacccggtaagggggtaaaccgtaacgggggtaaggtaaacccgtacgaaaccccgggttacgtaaggtccggaactccgggtaaacccc

SEQ ID NO: 215124 - DNA, 667 bp, Homo sapiens
  misc_feature: GYAE6OF01C6AMP.1.34.D01.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctctggcctcccgaggtaccagctgtgacatccaattcgacccagtctccatcctccctgtctgcatctagttgganacagacgtcaacctatccacgttcggccgggcgacgtcgaggccatccgagcgtatttcgtttacgccgttggttcgcgaacgacgaacggaaaccggnggggccgacgccccgtcgaagacgtacgtacgtctagtggtcacgtactaccgagtagttcggacggtaacgggtccgggtacccacgttaccgtacggttcgaaggttcggcgtagtcgacgtagtccgtagggactagtaacttacaccttcgtacaactactcgaacggcctacgtccgtagaccgtacgtacgtaaggtaacgttcttttacgaacttaaagttttcttaacgttacgtacttaacgttaattaacgttacgtacccgttacccgttagggacggttccggtaccgggacggaagggtacccgaagggtaccggtaactacccgaacggtacgtggtacgcgtcgaaccg

SEQ ID NO: 215125 - DNA, 764 bp, Homo sapiens
  misc_feature: GYAE6OF01E5G36.1.34.D01.1.454.CMB.1.raw
  modified_base (202)..(202): a, c, t, g, unknown or other
  misc_feature (202)..(202): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattcgacccagtcctccatccctccctgtctgcatctagttgganacagagtcaccatcacgttcggcccgggagacgtcacggccatcgagcgtatttcgttacgccgttggtcgacgagacaacggaaaccggacggggaccgaccggtccccctacgaagtacgttaccggtagttcctaaggttcggtcgacctaacgtacccgtaaggtagttcggacggtaaacgggggttccgggtaccccacgttcccgtagggtttaccgaagggttcgggacgtaggtacgtccgtaggttccggtagggtaacctaggttaacttacctaccgttcctacctaacgtacgtaccgacggtacgaaccgcccgttacgaccgaccggtaccgtaaggtaaacgtttgttttacgaacttttaaacgtttttaacgttaccgtacgtaaccttaaagtacgttttaactaaccgttaacccgttaccccgttaacgggtaccgggtacccggttacccggggcccggtaaacggggggtaaacccgtaagggttacgggtaaaacctcccggtaaaaccggtacggttaggtcggtacgacgtacccg

SEQ ID NO: 215126 - DNA, 855 bp, Homo sapiens
  misc_feature: GYAE6OF01E2H0B.1.34.D01.1.454.CMB.1.raw
  modified_base (101)..(101): a, c, t, g, unknown or other
  misc_feature (101)..(101): n is a, c, g, or t
  modified_base (188)..(188): a, c, t, g, unknown or other
  misc_feature (188)..(188): n is a, c, g, or t
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatggacatgagggtcccgntcagctcctgggctcctgctgctctggctccaggtaccagctgtgacataccaattcgaccctagttcctccattcctccctgttcngctatctagttcgganacagacgtcaccatcgacgttcggccgggagagtcaggcctaatccaggtacgtactttacgttacgccgttggttcgaccagaccaacggaaacccggngggacccgtaccgtccccttgaacgtacgttacggtagttacgtagttcgggtacgtacctacgtaccgtaaggtacgtttcgggaacccggttaacggggggttaccggggttacccctaggttacccgggttaacgggtttacgtaacgggttcgggtaccgtacggttaccggaccgttacggttaccggtacgggggtaaactaacggtttaacctttaacccggtaaccctttacccgtaacgttaaccctttagtaacccgttacgggacctttaacccggccgtacggtacccgtacgggtaacccgtttaagggtaaaccgtttttagttttacggttaaaccttttaacgtttttacgtttaaccgttaacggtaaccttaaacgtttaacgggtttaaacttacccggtttaaaccccgaccgggttttaccgggtaaacgggtcccgggttaaccgggccggtaaacggggtaaccggttaagtacccggggtaaactacccggtaaacggttacgttacgggtactcgttaacggaccc

SEQ ID NO: 215127 - DNA, 617 bp, Homo sapiens
  misc_feature: GYAE6OF01B6THL.1.34.D01.1.454.CMB.1.raw
  modified_base (270)..(270): a, c, t, g, unknown or other
  misc_feature (270)..(270): n is a, c, g, or t
  modified_base (325)..(325): a, c, t, g, unknown or other
  misc_feature (325)..(325): n is a, c, g, or t
  modified_base (582)..(582): a, c, t, g, unknown or other
  misc_feature (582)..(582): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattcgacccagtctccatcctccctgtctgctatctagtggagacagacgtcaccatccacgttcggcccgggacgagtcacggccatcgagcgtattctttagccgtggtcncagcaaggaaaccgagggccgacgcccctagacgtactcgtagtcgtagtggacnctacgtccgtagtagttcggacgtaacggggttcgggtaccctagttccgacggttcgaggtcgcgtagtcgtactagtcggaggtacgagttacctacacttactactactatacgcggactacgctagctacgtctagttaacttatttacatttaactttatactactaacgtaagtattaactaacgtacccgttaccgtcggtaccgtaccggttcgggaaccggtaaggggaccgtaaagggtaccggaanacccggaacgttagtacggcgtaacgtcgtacccg

SEQ ID NO: 215128 - DNA, 695 bp, Homo sapiens
  misc_feature: GYAE6OF01EK930.1.34.D01.1.454.CMB.1.raw
  modified_base (102)..(102): a, c, t, g, unknown or other
  misc_feature (102)..(102): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcctaggtaccagctgtgacatccaattgacccagtctccatccctccctgtctgcatctattggagacagagtcaccatcacttcggccgggcgagtcaggccatcagcgtattctttagctggttgcagcagaaaccgngggccgacgcccctnagagtcgtagtctagtggtgcatccagtattgacgtaagggtcgggtcccagtccgtaggttcgaggtggacgtagtcgctagtcgtagggactaggtacttaacaccttcgtaccaacttataccgagccacggtccctggaccgtaacgtcccgttaaggtaacgtttacgtttttacggaactttaaattttacgtttacgtacggtttaacctaaacgtttacgtttaatttaacgttaacccggttaacccccggtttaacgggttaccggggtaacccgggtttaccccgggggaccggtaaaccggggggttaaacccggttaaagggggttaaccggttaaaaccggtaacccggtaaacccggtaacggttacgggtcggttacccgtgtaaaccccgg

SEQ ID NO: 215129 - DNA, 869 bp, Homo sapiens
  misc_feature: GYAE6OF01AHVJN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccactccctccctgtctgctatctagttggagacagctcaccatctacgttcggccgggcgacgtcgacggccagtcgagcgttatttcgtttacgccggttggttcgacgacgacgaaacggaaaccggcggggaccgtaccggccccctgacgtacgttacggtagtccgttagtggtcgactacgtaccgagtacgttcggacggtaacgggggttccgggtaccctacggtaccggtaacgggttcgtaacgggttcggaccggttacgggtacgtaccgttaacggttaccggggtaacggggtaaccgttaacggttaactttaaccccgtaacccgtttaccttaacccgtaaaccgtttaacgtaaccgggaaccggttccgtaaccgttccccggtacggtaacccgtaaccggtaccgtttaaacgggttaaagttttaccgtttttaaccgtaaaccttttaaacgttttttaaccggtaaccgtttaacgttaaaccgttaaaacggttttaacgttttaaaccgttaacccggttaaacccccggttaacccggttagggtttaaccggggttaaccccggttaccggggaacccgggttaaccgggggtaacggtaaacgggttacccgggaaaccgtaaccgtaacccggtaaggttcgggtaccgggctaacggtaacccg

SEQ ID NO: 215130 - DNA, 691 bp, Homo sapiens
  misc_feature: GYAE6OF01AH802.1.34.D01.1.454.CMB.1.raw
  modified_base (207)..(207): a, c, t, g, unknown or other
  misc_feature (207)..(207): n is a, c, g, or t
  modified_base (561)..(561): a, c, t, g, unknown or other
  misc_feature (561)..(561): n is a, c, g, or t
  modified_base (620)..(620): a, c, t, g, unknown or other
  misc_feature (620)..(620): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggcctccgaggtaccagctgtgactactccaattcgacccagtcctccactcctccctgtctgctattctagtgganacgagactaccaaccactctacgtcggccgggtcgagtacacggcctacgtacacgtcttacgttcgtttacgccgttggttgacgacgacgaacggaaccggacgggaccgtacccgccccgtagacgtacgttcgtacgtcgttagcgggtacactactacgtagtacttacggacggtaaccggggtccggtacccgtacgttaccggtacggttacgacgggtcgtacgtacggtacgacgttacgtccggtacgggaactaacgttacctaacctacgttacccttactacgttaacacgaacgtccgaccgtaccgtgtaacccggtaccttaggtaacggtactttnttaacgtaactttaacgtttacgtactagtaactaattagttactaacgtcgttaccgngttacggtaccgcggtacggaggtaacgtcggtaacgaacttaccgaacgttacgtaggcctgcccgtacg

SEQ ID NO: 215131 - DNA, 628 bp, Homo sapiens
  misc_feature: GYAE6OF01BVOBQ.1.34.D01.1.454.CMB.1.raw
  modified_base (277)..(277): a, c, t, g, unknown or other
  misc_feature (277)..(277): n is a, c, g, or t
  modified_base (449)..(449): a, c, t, g, unknown or other
  misc_feature (449)..(449): n is a, c, g, or t
tcagacgagtgcgtcacgaccggtgctcgatttagatcgtctgtgttgggttgggggagtcagaccctgtcaggacacagcatggacatgacgggtccccgctcagctccgtggggctcctgctgctctggctcccaggtaccagctgtgacatccaattcgacccagtctccactcctccctgtctgctatctagtggagacagacgtcaccatcacgtcggccggcgagtcaggccatcgagcgattcttagcctggtgacgagccaagaaccgngggaccacgcccctagagtactcgttacgtcgtagtgggtgacctataccgagtacttcggacgtaaggggttccgggtaccctaagtccggtaggttaccgaagggtcgtacgagttccgactacgtcggtagggaactagtaacttaccgaccctcgtaccctaagtacncgtaacgctacgtccgtcgtacacgtacctagaacgtttattacgactttaagtttactacgtagtaacccgtaagttaacgttaactaacgtaccgtaacccgttagtacggtccgtacgggacccgtagggacccgtaggtacgacgtaccgtaaccgtagtggccgtgtcgtaacc

SEQ ID NO: 215132 - DNA, 632 bp, Homo sapiens
  misc_feature: GYAE6OF01ADQ9Y.1.34.D01.1.454.CMB.1.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (413)..(413): a, c, t, g, unknown or other
  misc_feature (413)..(413): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctagttggagacagacgtccaaccatccacgttcggccggggcgagtcacgggccatcagcgtattctttagcctggttgcagacaagaacgagggcgacgcccctnagatcgtagtctagtggtncactccagtattggacgtaaggggtcgggtacccagtccgtaggttcgaggtcggctaggtgctagtcgtgggactagtacttacactctactactancgagccacgcctcgcgtacgtacctaggtaactttattttcgaactttaacgttttaacttaccgtagttaactaacgttagtttaacttaaccgttaaccggttaccccgtagggttccgggtaccgggttaccgggacccgggtaagggggtaaccgtaaggggtaacggtaaaccggtaccgaaaccggttacgtcgggtacgtcgtcgtaacccg

SEQ ID NO: 215133 - DNA, 720 bp, Homo sapiens
  misc_feature: GYAE6OF01AETIQ.1.34.D01.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattcgacccagtctccatccctccctgtctgcatctattgganacagngtcaccatcacttggccgggcagtcaggccatcagcgtattctttagccttggttgcagcaagaaccngggcacgccccanagactcgtagtctagtggtcgctatccgaagtacgtttcgacgtaacggggtccgggtaccctacgtccgtagggttacaggtcgggactaggtcgactacgtcgtaggggacagtaacttaccacttctacgacttactacgacgtccaggtcccgtaggaccacgtaccgttaaggtaacggtttacttttacggaaccttttaatttttaaccgttacgttacggtttaaccaaaacgtttaagtttaacctttaacgttaacccggttaacccccgttaggggttacccgggtaacccgggtttacccggggaaacccgggtaaccggggggttaaaacccgtaacgggggttaaccggggtaaaaccgtttaccccggaaaacccgggttacggtttacgggtaccggtccgttaccggtaaaccccgg

SEQ ID NO: 215134 - DNA, 764 bp, Homo sapiens
  misc_feature: GYAE6OF01B9BYI.1.34.D01.1.454.CMB.1.raw
  modified_base (302)..(302): a, c, t, g, unknown or other
  misc_feature (302)..(302): n is a, c, g, or t
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccacttccctccctgtctgctatctatggagacagagtcaaccatccacgttcggcccgggacgtacggtcaggcccataccgagtcgtattcgtttacgcccttgggttcgacagaccgaacgaaaccgngggacgaccgcccctagacgtatccgtagtcttagtggtcacgtactaccgagtagttcgacgtaaggggtaccgggtacccaacgtccggtaggttctaggtacggacgtaggtcgctaacgttcggtacgggtaacctaggtaacgtttaccaccttaccctagtaactacgtccggaacncgtacggacctggacctacggtacctaggaaacgttttatttaccggtaaactttaactttttaacggtaccgttaacgttaaccgtaaaccgttaaagtttaaccgtttaacttaaacccggttaaccccggttaacggttaccgggttaacccgggttccgggtaaaccgggtaaacggggggtaacccgttaaaagggggttaccggttaaaaccggtaacccggttaaaacccggttaacgggttccggtaacggttcccggtaacgtaacccgg

SEQ ID NO: 215135 - DNA, 718 bp, Homo sapiens
  misc_feature: GYAE6OF01CV1XI.1.34.D01.1.454.CMB.1.raw
  modified_base (148)..(148): a, c, t, g, unknown or other
  misc_feature (148)..(148): n is a, c, g, or t
  modified_base (451)..(451): a, c, t, g, unknown or other
  misc_feature (451)..(451): n is a, c, g, or t
tcagacgagtgcgtcacgaccggtgctcgatttagatcgtctgtggttgggtttgggggagtcagaccctgtcaggacacagcatggacatggacgggtccccgctcagctcgtggggctcctgctgctcgtcggcctccgagtaccngcgtgtacgactactacctaacgttcgaccctacgtcctacctaccttccctcctcgtctcgactacttactagttaggacgacgacgtacgtacaactactccgtacggttcgggccgggacgtacgtacgacgcacgtacacgtcttacttctacgtcgttcgtacgacgacgacgaacggaaccgtacggaccggaccgtcccgtacgtaacgtacgttacgtacgtacgtaggtcggtcgtactaacgacgtagtacgtacggacggtacgggtcggtaccgtacgtacgtacgtacgnggtcgagtacgcgtcgtagtcggtacgacgtacgtactacgctaccgtactactactacgacgtaccgtacgaccgtcggtataccgtaacggttacgttaagttactttaacgttacttaaattaccggttataacggtaccttaaacgttacgttaacttaccgggttaacccacggtttcggaacccggtggggttaacccgacggttaacggggacttagggaaccgtacgttaaacacggttagacggtcggctcggtaacc

SEQ ID NO: 215136 - DNA, 658 bp, Homo sapiens
  misc_feature: GYAE6OF01EGZVK.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttggggggagtcagaccctgtcaggacacagcatggacatgagggtccccgctcagctcctggggctcctgctgctctggctcccaggtaccagctgtgacatccaattcgacccagtctccacttcctccctgtctgctatctatggagacagagtcaccatcacgttggccgggcgagtcaggccatcgagtctattcgtttagccgttggttgcagacaagaaaccgngggccacgcccctgagtacttcgtagtctagtcgggtcgcataccagtatcgacgtaaggggtcgggtaccctagtccgtaggttcgaggtcggactaggtcgactagttcggtagggaactaagtaacttaacctaccgttactactacttactacgtacgaccgtacgtccgtcgtaccgacgtaccgtacgtaacgttatttacgtactttaacttttaacttacgttactaacgtaacttaacgttaagtttaacgttaaccgttacccgtaccggttacgggtaccggttaccgggaccgggttttaacgggaacggtaacgggtaacggtaacgtaaccgtaaccgtaacgtaggtcggtcgtcgtaccg

SEQ ID NO: 215137 - DNA, 831 bp, Homo sapiens
  misc_feature: GYAE6OF01BRRA2.1.34.D01.1.454.CMB.1.raw
  modified_base (213)..(213): a, c, t, g, unknown or other
  misc_feature (213)..(213): n is a, c, g, or t
  modified_base (319)..(319): a, c, t, g, unknown or other
  misc_feature (319)..(319): n is a, c, g, or t
  modified_base (818)..(818): a, c, t, g, unknown or other
  misc_feature (818)..(818): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggctcctgctgctcgtggcctcccgaggtaccagctgtgacataccaattcgacccagtcctccactccctccctgtctgctattcgtagtggganacagacgtccaacatcctacgttcggccgggagacgtccgaaggccatccgagtcgttattttaccgttacgtccgttggtagacacgaccgaaacggaaaaccgnggggacctaaccgcccctagaacggtatacggttagtctaaggtgcacgactaccgaagttactaggacgtaacgggggttcggtaccctaaggttacccggaggttacgacgggtcggaaccgtagttccggagtacgttacgggacgggaactaacgttacttaacccaccgttcttaacctacttaacgagtaccggaccacggttcccaggaccgtaaaccggtcgttaaagtaacgtttttacgtttaacgtaaaccttttttaagtaacttttaccgtaaccggtaaacgttaaacgttaaggttttaaccccttaaggttaaaccccccggttaaccccgtttagggggtaaccggggtttaaacccccggttccgggggaaaccccgggttaaaggggggtaaaaccctttaaaggggggaacggttaaacccggttaaaccccggtaaaccggttaaaccggggttggtttaaccccgggaaaccccgtnttaaaacccccgg

SEQ ID NO: 215138 - DNA, 676 bp, Homo sapiens
  misc_feature: GYAE6OF01AWRZ9.1.34.D01.1.454.CMB.1.raw
  modified_base (332)..(332): a, c, t, g, unknown or other
  misc_feature (332)..(332): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccactcctccctgtctgcatcgtattggagtacagacgtcacctatccacgttcggccgggacgagtcgacggccatcgagtcgtatttcttacgccgttggttcgcacgacaagaaaccgagggccgacgccccgtcagtactcggtagtcgtagtcggtcncactccagtacttggcgtaaggggtcgggtcccacgtaccgtagggttctaggtggcgtaggtcgacgtagtcgtagggaacagtacttacgaccttacgtactaccgttactaccgacgtacgaacgtcccgtacgcctaacggtcccttaagggtaaacgtttacgttttacgtaacgtttaaacttttacgtttaacgttacgttaacctaaacgttaagtttaacttaaccgttaacccggttaacccgttacgggtacggttaaccggtccgggtaccggacgggtacggtaacggtacggtaaacgtcccgaaacgtacgtagtcggacgtcgtaacc

SEQ ID NO: 215139 - DNA, 685 bp, Homo sapiens
  misc_feature: GYAE6OF01BOVA1.1.34.D01.1.454.CMB.1.raw
  modified_base (321)..(321): a, c, t, g, unknown or other
  misc_feature (321)..(321): n is a, c, g, or t
tcagacgagtgcgtcacgaccggtgctcgatttagatcgtctgtgttgggtttgggggagtcagaccctgtcaggacacagcatggacatggagggtccccgctcagctccgtggggctcctgctgctctggctcccaggtaccagctgtgacatccaattcgacccagtctccatccctcctgtctgctatctatggagacagagtcacatcacgttggccgggacgagtcaggccatcagcgtatttcttagccgtggttgcagcaagaaaccgaggggccgacgcccctagacgagttccgtagtctagtcgggtacnctactccgtagtagttcgacggtaacggggtcgggtccctacggtacccgtaggttcgacggttcgggacgtacggttcgaccgtagtcggttagggaacctaggtacttaccgtactccgtactaacttactccgagtaccacggccttacggacaccggtacctaggtaaacgttttacgtttcgaaacgtttaatttaccgttaacgtacgtaacctaaacgtttaagttacttaacgtttaccgtaacccgttaggttacggtaaccgtaccgggtaccgtaacgggggtaaccgttaagggaccggttaaacgtaacccggaaccgggtaacgtttggcggttaaccgtggtaaacccg

SEQ ID NO: 215140 - DNA, 838 bp, Homo sapiens
  misc_feature: GYAE6OF01AIS6R.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctcgtggctcccaggtaccagctgtgacatccaattcgaccctagtctccattcccgtccctgtctgacctagttctagttggagaactagacgtccacctagtctaccgttcggcccggggcgtacgtcgaacggccctagtaccagccgtatttccgtttacgccgttagggttcaccgacggaccgaaacggaaacccggtacggggaccgtacccggtcccccgtacgaacggtacgttaccggttagtccgttaaggttcggtacgacgtagtaccgagttacgttacgacgggtaacggggttccgggtacctaacgttccggaggttacgacggtcgacgtaggtacggcttaacggtcggtaacgggactaaggttaccttactaccgttacccgtacttaacgtactccgaaacgccgtaaccggtcccacgggtacaccgtttacgaacctttaaagggtttccttttaacgaaacgtttttaacgttttaccttaacggttacttaacgttaaaccgttaagtttccggtttaaacgttacccccgtaacccggtttagggttaccggaacccgggtttacccgggtaacggtaaccgggggttaaccggttaaaggggtaaccccggttaaaaccggtaaaccggttaaaccccgggttaaagttcccggggtttaacggtccggtaaaacccggttcccg

SEQ ID NO: 215141 - DNA, 743 bp, Homo sapiens
  misc_feature: GYAE6OF01A0QPY.1.34.D01.1.454.CMB.1.raw
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
tcagacgagtgcgtcacgaccggtgctcgatttagatcgtctgtgttgggtttgggggagtcagaccctgtcaggacacagcatggacatggacgggtcccccgctcagctccgtggggcctcctgctgctcgtggcctcccaggtaccagctgtgacataccaattcgacccagtctccatccctcctgtctgcatctagttggagacagacgtccaccatccgacgttcggccgggtacgacgtccaggccaatcgagccgttatttcgtttacgccgttggttgaccgagaccgaacggaaacccggnggggaccgaccgacccccgtagaagtacgtccgtagtcgtagtcggtacnctacgtacgaagtcgtaggaccggtacggggtccggtcccaacgttccggtacgggttacacgggtggacgtaggtcgacgtacggttccgggaagggaactaacgtacctttacccgacttcctaacgtacctacgtacgaccggtaccgaccggttacccgcgtaccggaccgtacgttaacgtagttttacgttacgtaacttttacgtttacgttactacgtaactaacgttattaacgttaccgttaacccggtaaccgttacgggtaccgggttaacggttcccgggtaaacgggtacggggtaaaccgtaacggggaacggtaaacgttaacccggtaacccggtaagttccgggtaaccgtcgaacccgtaccg

SEQ ID NO: 215142 - DNA, 675 bp, Homo sapiens
  misc_feature: GYAE6OF01EIW6J.1.34.D01.1.454.CMB.1.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
  modified_base (669)..(669): a, c, t, g, unknown or other
  misc_feature (669)..(669): n is a, c, g, or t
tcagacgagtgcgtcacgaccggtgctcgatttagatcgtctgtgttgggtttgggggagtcagaccctgtcaggacacagcatggacatgagggtccccgctcagctcctggggcctccgtgctgctctggctcccgaggtaccagctgtgacatccaattgacccagtctccatcctccctgtctgcatctatgganacagatcacctatcacgttggccggagagtccaggtccaatcgaagcgtattcgtttaagccgttggttcgcagcaagaaaccgngggccgacgcccctagacgacttcggtagttacgtagtcggtagtactaagttcccgaaggtattcggaccggtaacggggtcgggtacccctagtccgtacgggttcagggtcggacgtaggttcgactagtcgtaggggaactaggtaacttacctacgttacctacgtaacgttatacgaacgtcgtacgccgtacggcctacggtacctaaggttaatttagttttaacggactttaaacgttttacttacgtaacggttaactaaacgttaaggttaactttacggtaacccgttaacccggttagtaccgggtacgtttaccggacggtaacgggtaacgtaagggtacgtaacgtacgaaccggtaacgtgcggtcgngtaccg

SEQ ID NO: 215143 - DNA, 603 bp, Homo sapiens
  misc_feature: GYAE6OF01AMQWH.1.34.D01.1.454.CMB.1.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattgacccagtctccatcctccctgtctgcatctattgganacagagtcaccatccacttggccgggcgagtcaggccatcagcgtattctttagccttggttgcagcagaaaccgngggcacgcccctnagatcgtagtctagtggtgcactccgagtattcgacgtaaggggtcgggtaccccagtcccgaggttcaggtggcaggtcgctagtcgagggactaggtacttaccacgttccactaccttatccgagtccacgtcccgtgaccacgtaccgtaggtaactttatttacgaactttaatttacttactcgtaacaattagttaacttacgtacccgttacccgtacgggttacggtaccgttccgggaccgtaacgggggtaacctagggtacggtaacgtaccgaaaccggtacgtaggtccggtgtccgtaccg

SEQ ID NO: 215144 - DNA, 766 bp, Homo sapiens
  misc_feature: GYAE6OF01CMZ93.1.34.D01.1.454.CMB.1.raw
  modified_base (105)..(105): a, c, t, g, unknown or other
  misc_feature (105)..(105): n is a, c, g, or t
tcagacgagtgcgtcacgaccggtgctcgatttagatcgtctgtggttggggtttgggggagtcagaccctgtcaggacacagcatggacatggacgggtccccntcagcctcgtggggctcctgctgctcgtcggcctacccgaggtaccagtctgtacgaactactaccgtaaagttccgaccctacgtcctcctaccttcccctccctgtcctacgctacttcgttaagtggaagtacagtacctacacctactcgtacgtcggccgggacgaggtccgacggccagtacgacgtcgttactttaccgttcggcgttcggtgaccgaagaccgaaacggaaaccgggtcgggaccacccgacccctagaacgtacgttacggtaacgttcgtaaggtcggactaacctataccggtaagtacggtaccgggtacgggttaacgggggtcccggtaccctaaggtcccgggtaggttacgacgggtcgacgtaggtacgtcggtaacgtcggggtaaactacggtaacttaccttaaccgaccttactaacgacttagaccgacgtaccgacgtccgtaacggcttaaccgtagttaacgttagtttattaagtaacttttagttaacttacggtaacctaacttaagttaacttacgtaaccggttacccttaacggtaccggtacggttcgggtaacccggacggtacggtaacggtaggtaccgtaaacggaccctaagggtacacgggctccgtagaccc

SEQ ID NO: 215145 - DNA, 702 bp, Homo sapiens
  misc_feature: GYAE6OF01A8NM2.1.34.D01.1.454.CMB.1.raw
  modified_base (696)..(696): a, c, t, g, unknown or other
  misc_feature (696)..(696): n is a, c, g, or t
tcagacgagtgcgtcacgaccggtgctcgatttagatcgtctgtgttgggtttgggggagtcagaccctgtcaggacacagcatggacatgagggtccccgctcagctcctggggcctcctgctgctcgtcggctcccaggtaccagtctgtgacatccaattgacccagtctccatcctccctgtctgcatctattggagacagagtcacctatctacgttcggccgggactacggtcacggccatcgagtcgtactttcgtttagccgttggttacgcgacgtacgaaacggaaaccggtcgggaccgacgcccctagacgtacgttacggtacgtcttagtggtacgaccacttaccgagttacgttacggacggtaacggggttccgggtaccctaacgttacccggtaacggtttacgtaacggtcggtacgtaggtcgacgttacggttacggtacgggtaactacggtaacctttaaccgacgttaccgtaaccttaacgttaacgttaaccgacggtaccgtaccggtcccttagaacccggtacgttacctaagggttaccgtttaatttacggaactttaaagttttaactacgtacgtaactaagtacgttacttaccgtaccgtaccttaggtcggtaccgttcggacgtagggacgtggacgtaagtacaacgtagtgtcgtncgtacc

SEQ ID NO: 215146 - DNA, 865 bp, Homo sapiens
  misc_feature: GYAE6OF01EG7IN.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggttgggggagtcagaccctgtcaggacacagcatggacatgacgggtccccgntcagctccgtgggctctgctgctctggctcccgaggtaccagctgtgacacgtccaattcgaccctagtcctccacttccctcccgtgtcctagcctatcgtagtcgggaacgacaggactaccaaccctagttacctaacggttcggacccgggggtactaacggttaccaacgggcctaatcgaacggtccgtactttaccgtttacgtcccgttaggttacgaccgacgtacgaaacggaaaccggtaggggaccggtaaccggtaccccctaggaacgtacgtttaccggttacggttaccttaacggttcgggtactaccgacgtttaaccccgaaggtaacgttttacgggaaccgggtaacgggggtttacccggggtaccctaacggggtacccggttaacggggttacccggtaacggggttacgggaccgttaacgggtacggtaccgttaaccggttaccggtacgggtaacgtaacggttaacttaacccgttaacgtacgtaccgtaacgtacctacggtaacgtaccgaacggtccgttacggacctaacggtacgttaaaggtaccgtttatttaccgtaacgtttaactttaaacgtaccgtacgttaaccgtaaacgttagttaacttaccgttacccgtaaccggttcgggtaaccggtaccggttacggaccggtaaggggaaccttaaggggtaccgtacgtaaaccgtaccggtaactgggttacgtcccgtaggttacccc

SEQ ID NO: 215147 - DNA, 731 bp, Homo sapiens
  misc_feature: GYAE6OF01DF563.1.34.D01.1.454.CMB.1.raw
  modified_base (103)..(103): a, c, t, g, unknown or other
  misc_feature (103)..(103): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (690)..(690): a, c, t, g, unknown or other
  misc_feature (690)..(690): n is a, c, g, or t
  modified_base (693)..(695): a, c, t, g, unknown or other
  misc_feature (693)..(695): n is a, c, g, or t
  modified_base (697)..(698): a, c, t, g, unknown or other
  misc_feature (697)..(698): n is a, c, g, or t
  modified_base (700)..(700): a, c, t, g, unknown or other
  misc_feature (700)..(700): n is a, c, g, or t
  modified_base (702)..(711): a, c, t, g, unknown or other
  misc_feature (702)..(711): n is a, c, g, or t
  modified_base (713)..(731): a, c, t, g, unknown or other
  misc_feature (713)..(731): n is a, c, g, or t
tcagacgagtgcgtcacgaccggtgctcgatttagatcgtctgtgttgggtttgggagtcaggccatcagcgattctttagcctggttgcagcaagaaaccgngggccgacgcccctcagtatcgtagtctagtggtgcactccagtagttcgacgtaaggggttcgggtaccccagttcccgtagggttccaggtggcaggttcggctaacttcggagggacctaagtacttaacnctcganaacttagcacgcacgtcgtgccacgtccgtagtaagtgttttacaacctttaaagttttccgtaacttacgtaaccgaaaccgtttaagttaaactttaaccggtacccgttaacccccggttagggttaccgggtaccccggtttaccggggaacccgggtaaaggggggtaaacccgtaaaggggtttaccggtaaaagttaaaccccgaaaaaccccgggttacgggttacgggtgtaaccccgtacggtaaaccccccgttaacgtacgtttcggtaccccttttacctttaccggacccgtttccccggttccccgaaaccgtttaggtacccgtaacccggtaaacgttaccccttcccggttaaaccggtggttaacccggggccgggtacgggtaccgggtacgaacgggtacggaccgtagtagcgacgtangnacgnacnnntnngngnnnnnnnnnngnnnnnnnnnnnnnnnnnnn

SEQ ID NO: 215148 - DNA, 713 bp, Homo sapiens
  misc_feature: GYAE6OF01C45T9.1.34.D01.1.454.CMB.1.raw
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccgaggtaccagctgtgacatccaattcgacccagtctccatcctcctgtctgcatctattggagacagagtccaccatcacgttggcccgggngagtcaggccatcgagcgtattcttagccttggttgcagcaacgaaaacgngggccgacgcccctnagactcggtagtcctagtggtcgacactaccagtagttcggacgtaacggggttcgggtacccctagtacccgtaggttacgaggtggacgtacggtcgacgtagtcggtacgggaactacggtaactttaaccaccttcttaacaacttacacgacgaccgacggtcctacggaaccgtacgtacctaagggttaaacttacgtttttacgaacttttaaactttttacgttacggttaactactaaacgttaagtttaaactttaccggtaacccttaacccccgggttaagggttaccgggttaaccgggtttacccggggaaccgggtaaacgggggtaaacccggtaaaagggggttacgtaaaacgtacccgtaaaaccgggttaatcgggttaaccggcgtacgtaaacccg

SEQ ID NO: 215149 - DNA, 642 bp, Homo sapiens
  misc_feature: GYAE6OF01C6GLJ.1.34.D01.1.454.CMB.1.raw
  modified_base (230)..(230): a, c, t, g, unknown or other
  misc_feature (230)..(230): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtcccccgctcagctcctggggcctcctgctgctctggctcccaggtacccagctgtgacatccaattgaccccagtcctccatccctccctgtctgcattctatggagacagatccaccatcacttcggccgggngagtcaggccatcagcgtattctttagccgttggttgcagacaacgaaaccgagggccacgcccctanagactcggtagtcgtagtggtcgacacgtaccagtattcggacggtaaacgggttcgggtaccctacctccggtaggttacaaggtgggacctaaggtcgtccgtagttaccgagggtaactacgtaactttaccgacttacctacacctaatccgaagacctaacgtcctagccacgccgtagttaacgttatttacgtaacttaatttacgttacttagtactaaacgtattaagttactaaccgttaccccgtaggtccgggtaccgtacggtacccggaacgggtaaccgtaagggtacgtaagtaccgtaaaccggtagtcggtacgtgtcgtaacccg

SEQ ID NO: 215150 - DNA, 745 bp, Homo sapiens
  misc_feature: GYAE6OF01ELW39.1.34.D01.1.454.CMB.1.raw
  modified_base (102)..(102): a, c, t, g, unknown or other
  misc_feature (102)..(102): n is a, c, g, or t
  modified_base (224)..(224): a, c, t, g, unknown or other
  misc_feature (224)..(224): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattcgacccagtctccatcctcctgtctgcatctagttggagacagagtcacatcacgttggccggngagtcgacggccatcgagcgtatttctttacgtccgttggttcgacacggacaacggaaaccggacgggccgaaccgcccccttagaacggtaacgttacggttacggttccttaggtgggtcgacgacttccgaaagttcgttaggaccggtaacgggggttccgggtacccctaggttacccgtagggtttacccgagggtttaccggacgtagggttaccgtacgttaacgttccgggtaaggggaaccgttaaggtaaccgtttaaccgtaccttacctaacgtaaccttagtaccgaacgacgaccgtccgacgtacgaccgtacgtaaggtaacgtttacgttttacgactttaaacgttttacgtacgtagttaaccaagttaagtttacttaacgtttaacccgtacccgttaggttaccgggttaccgttaccgggtaccgggaaggggtaacccgtaaggggtacggtaaacgtaaccggaaccgttaacgtggtaccgtcgtaccgtacc

SEQ ID NO: 215151 - DNA, 593 bp, Homo sapiens
  misc_feature: GYAE6OF01BK82J.1.34.D01.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (369)..(369): a, c, t, g, unknown or other
  misc_feature (369)..(369): n is a, c, g, or t
  modified_base (433)..(433): a, c, t, g, unknown or other
  misc_feature (433)..(433): n is a, c, g, or t
  modified_base (481)..(481): a, c, t, g, unknown or other
  misc_feature (481)..(481): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatccctccctgtctgcatctattgganacagagtccaccatcacttgccgggcagtcaggccatcagcgattcttagcctggttncagcagaaccgngggcacgccccgtnagtactcggtagtctagtggtgcctactccaagnttaggacgtaacgggtcgggtacccagtcccgagtttacgaggtcgcgagtncgaagttccgtagggaccaaggtacttaccgaccttacaccgtactactcgacggactcgtccnggacctcgtacctaggtaagttagttttacgacttaagtttacttacncgttacaaacgttagtacttaacgtaccgtacccgtacggtgtaccgttacggacgtacggggaaccgtagggtacgtaactaccgaaaccgtcgtagtacgctgtaacccg

SEQ ID NO: 215152 - DNA, 774 bp, Homo sapiens
  misc_feature: GYAE6OF01B3I1P.1.34.D01.1.454.CMB.1.raw
tcagacgagtgcgtcacgaccggtgctcgatttagatcgtctgtgttgggtttggggagtcagaccccgtcaggacacagcatggacatgacgggtccccgctcagctcctgggctcctgctgctctggcctccgaggtaccaggctgtgacatccaattcgaccagtcctccactcctcctgtctcgctatctagtaggacacgagactccactacttctacggtcggaccgggtctacggcgacggtcagtacgagcgttactttcgttacgtccggtggttcgacgtaccggaacgaaacggaaccgtcggggcccgaccgtccccgtagaacgtcttaacggtacttacgtagtcggtacgactactacgagtacggttacgacggtacgggtaccgtaccctacgttaccgtaggtccgtacggtacggtcgtaggtacgtacgtacggtacggtaacgggaactattaaccggtttaacctaccgttaaccttaccgtaaacgtttcgaaccgtacgacgaccgttacgcgacgttaccgggtactaagtacgttttacgtactaaaccgttttaattacggttataaccggttaaacgtaacttaacgttaacgttacctaaccccgggttacgttaaaccgggtcggtttaaacccggcggggtaaaccgggacccggtttaaagggacgttaaaaccggggtaacccgtaacgtaaacccggggtacttacgggtacccgttaaccgtcgggaacccctttaagg

SEQ ID NO: 215153 - DNA, 519 bp, Homo sapiens
  misc_feature: GYAE6OF01A71RN.1.34.D01.1.454.CMB.1.raw
  modified_base (248)..(248): a, c, t, g, unknown or other
  misc_feature (248)..(248): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
tcagacgagtgcgtcacgaccggtgctcgatttagatcgtctgtgttgggtttgggggagtcaggccatcagcgattctttagcctggttgcagcagaaaccgagggcgagcccctcagatcgtagtctatggtgcatccagattggcaaggtggggtcccatccgaggttcagtggcagtgcatcgtgggacagtattacactctcactatcagcagcctgcagcctagagtattttgactaatttnttactgtacaaacagttatactacgtaccctagtcggaacgttcggacgaggggacctagggtaggaataccaacgtacgtggtacggctgactactatactcgtctactattcctccgctatccgtgaaccgctacgtccgtctacggacgtcgggtctggacaacgggcacgtagacggntnactgactnacntgatnacngctgtctagngtacngtcagacgagngcgcgtacgngactcgacgcgcgctgtcacactctcgtcgtc

SEQ ID NO: 215154 - DNA, 796 bp, Homo sapiens
  misc_feature: GYAE6OF01BTCQC.1.34.D01.1.454.CMB.1.raw
  modified_base (143)..(143): a, c, t, g, unknown or other
  misc_feature (143)..(143): n is a, c, g, or t
  modified_base (345)..(345): a, c, t, g, unknown or other
  misc_feature (345)..(345): n is a, c, g, or t
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctgcctcccaggtaccngctgtgacatccaattcgacccagtcctccatccctccctgtctgctatctagttggagacaggatccaacctatcctacgttcggcccgggtcgagtcacggcctatcgaagcgtactttcttagtccgttggtgcagaacgaacggaaaccgcgggccgaaccgtcccctagacggtattccggtagtcgtagtggtacnctacgtcagtacgtttcggacggtaacgggtccggtacctacgtacccgtaggttcgaggtcggtacgtagtcgactggttacgtacgggtaactagttaaccttacaccgttaccgtaactacgttaaccncgaacgtaccgtaccgtacccgtcggtaaccccaggttaacccgttagtaaacggtttttaccgttacgtttaaccgtttttaaatttaacccgtttaggttacgttaaaccccgttaaagttttaacgttaaccgttttaacccggttaaccccggtttaaacccccgggttcggttaaaccgggggttaaccccggttcggggtaaaaccccgggtaacgggggttaccggttaaacgggggtacggtaaaccccgttaaacccgggtaaacccggtaccgtttaccggggttcggaaccccgttcgggaaaccccc

SEQ ID NO: 215155 - DNA, 660 bp, Homo sapiens
  misc_feature: GYAE6OF01DVJ4F.1.34.D01.1.454.CMB.1.raw
  modified_base (446)..(446): a, c, t, g, unknown or other
  misc_feature (446)..(446): n is a, c, g, or t
  modified_base (639)..(639): a, c, t, g, unknown or other
  misc_feature (639)..(639): n is a, c, g, or t
  modified_base (650)..(650): a, c, t, g, unknown or other
  misc_feature (650)..(650): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggcctcccaggtaccagctgtgacatccaattgacccagtctccatcctccctgtctgcatctagttggagacagacgtccaaccattcacgttcggcccgggcgaggtcacggccatcgagcgtatttcgtttacgccgttggttcgcaggaccgaacgaaaccgcggggaccgaccgcccctacgagtacgtacggtaagtcctagtgggtacacgataccgagtagttcggacgtaacggggttcgggtacccacgttccgtaggttcaggtggcgtagtcgacgtagtacggtagggaactagtacttaccncttacactacttacacgagcacgcacgcgacgtcttaagtagttactttgaactttaagtttactacgttagtacctaaagttattaactttacgtaaccttaccccgttaggtacgggttacccggtaccggaaccgggtaacgggtacggtaaagggtaacggtaacggttaaccgtaaaccgggttaagnggttaccggtntccggaaccg

SEQ ID NO: 215156 - DNA, 685 bp, Homo sapiens
  misc_feature: GYAE6OF01DGTGW.1.34.D01.1.454.CMB.1.raw
  modified_base (202)..(202): a, c, t, g, unknown or other
  misc_feature (202)..(202): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
tcagacgagtgcgtcacgaccggtgctcgatttagatcgtctgtgttgggtttgggggagtcagaccctgtcaggacacagcatggacatggagggtccccgctcagctccgtggggcctcctgctgctctggctcccaggtaccagctgtgacatccaattcgacccagtcctccatccctcctgtctgcatctagtgganacagagtccaccatcacgttcggccgggtcgacgtcgacggccatcgagtcgtatttcttacgccgttggtncagacaacgaacgngggcgaccgccccgtanagacgtcgtagtacgtagtggcacnctacgagtacgtcgacgtaacggggtcgggtacccagttccggtaggttcgtacggtcgggctaggtcgactacgttcgggacgggtaacacgtaacttacccaacttcctactaaccgtataccgaacggtcaccggtcctgaccggacgtaccgttagtaagttacttttacgaactttaattttactaacgttctaactaatagttttaactttaccgtaacccgtttacccgtaggtacgggttaccgggttaccgggaccggttaaccgggggaaacggaacggggttaccggtaaacgtaccccgtaaaaccgggtacggtttcggaacgggttcccgtgtaaaccccg

SEQ ID NO: 215157 - DNA, 775 bp, Homo sapiens
  misc_feature: GYAE6OF01BD2QI.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccactccctccctgtctgctatctagtggagacagacgtcaacctatcctacgttcggaccgggcgtacgtacgacggcctatcgacgtcgtaactttcgtttacgtccgttggttcgacgacgaccgaaacgaaaccggacggtaccggaccgtacccctacgacgtacgttacgtaacgttacgtagtcgggtactacgtactaccgtagtacgttacggacggtaacggggtccggtacctaacgtaccgtaggttacgtaggtcgtacgtcggtacgactacgtcgtagggaactagtactaacctaccttacctacgaacctttacgacgacggtactacccgtcctcggaccgtaacggtcccgttaaagtaaggttttacgttttaccggttaaatttaaccgttttaacgttacctaacggttaaccttaaacgttacgtttaaaccttaccggttaaaccctaccccgggtttaaggtaaccgggttaccgggttccggtaaacccggggaacgggtaacccggtaagggttaacgggtaaaaccgtacccggtaaaccgggttacgtagggttcccgtacggtaaccgtacccg

SEQ ID NO: 215158 - DNA, 810 bp, Homo sapiens
  misc_feature: GYAE6OF01A4X68.1.34.D01.1.454.CMB.1.raw
  modified_base (104)..(104): a, c, t, g, unknown or other
  misc_feature (104)..(104): n is a, c, g, or t
  modified_base (153)..(153): a, c, t, g, unknown or other
  misc_feature (153)..(153): n is a, c, g, or t
  modified_base (572)..(572): a, c, t, g, unknown or other
  misc_feature (572)..(572): n is a, c, g, or t
tcagacgagtgcgtcacgaccggtgctcgatttagatcgtctgtggttggggtttgggggagtcagaccctgtcaggacacagcatggacatgagggtccccgntcagctccgtggggctcctgctgctctggcctcccaggtaccagctgtnactatccaattcgacccagtcctccatcccgttccctgtctcgctattcgtagttggaacgacgagacgtccaaccacgttaccacgttcggccggggtacgacggtcgacggtccaagttcaacggtacgttatttaccgtttacgtccgttaggttcggacaaggacaaacggaaaacccggtcggggaccggtaccgacccccgtagaacggttacgttaccggttaacgtcggttaaggtacgggttacaccgtaacgttaccgaagttacgttacggtaaccgggtacgggggtacccgggttaccaaggttccccggtaaggtttacgacggggttcgacggtagttacgggacttacggtcggtagggtaacagttactacaccgttctacaacttagaccgagtacccgancccgtataccaacgtcgtaagtaatttacgtttagaaccttttaatttacgtttaccgtagtaaaccgttaaagttaagtttaccttaccggttaacccggtaaccccgtttagggtaccggttaccggggttaacccgggacgggttaaaccggggaccgggtaaaagggttcccggttaaacgttaaacccgggaaccgtttaaccgggacggttcgggtaacctccgggtaaccc

SEQ ID NO: 215159 - DNA, 698 bp, Homo sapiens
  misc_feature: GYAE6OF01CD6Z4.1.34.D01.1.454.CMB.1.raw
  modified_base (355)..(355): a, c, t, g, unknown or other
  misc_feature (355)..(355): n is a, c, g, or t
tcagacgagtgcgtcacgaccggtgctcgatttagatcgtctgtgttgggtttgggggagtcagaccctgtcaggacacagcatggacatggacgggtccccgctcagctccgtgggctcctgctgctctggcctcccaggtaccagctgtgacatccaattcgaccagtctccatcctccctgtctgactatctagttggagacagacgtacaacctatacctaccgttcggcccgggacgagtccgacggccataccgagtcgttactttcgtttacgccgttgggttcgactacgacgaacggaaaccgacgggacgaccgcccctacacgtactcggtagtctagtcggtnactactccgtaagtcgtttcggacggtaacggggtcgggtaccctacgttcccggtaggttaccgtaggtcggctagggtcgtacgtacggtcggtacgggaactacggtaaccttaccgtaccttctacgtaccttaacgcgtacgccgtacgccgtacgacggccgtacgtaagttaacgttagttttacgacttttaacgtttaactttactaacgttactaacgttattaactttacgtaacccgttaccgtacggtgggtaccgtccgggaacgtaacgggaacggtcgggtaacgtaacgtacccggtaaacgtacgtaggtccgtacgtcgacccg

SEQ ID NO: 215160 - DNA, 787 bp, Homo sapiens
  misc_feature: GYAE6OF01AVP6D.1.34.D01.1.454.CMB.1.raw
  modified_base (102)..(102): a, c, t, g, unknown or other
  misc_feature (102)..(102): n is a, c, g, or t
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (335)..(335): a, c, t, g, unknown or other
  misc_feature (335)..(335): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctctggctcccaggtaccagctgtgacatccaattcgacccagtcctccatccctccctgtctgcatctatgganacagatccactatctacgttcggcccgggngagtccgaggccatcgagcgtatttcttacgccgttggttcgcagacaacggaaaccgagggaccgaccggcccctagagtacgtcgtaagtcctaggtggtacnctactacgagtagtggacgtaacggggtcggtaccccagtaccgtaggttcgaggtcgacgtaggtcgactacgttcggtacgggtaactaacgtaacgttaacctaccttactaccgtacttactacgacgtacctaaccgtccttacggaccgtacgtacccgttaggttaaacgtttacgttttaacgtaactttaaagtttttaacgttaaccggtttaacgttaaaccttaaaacggtttacgttttaaaccgttttaaaccgttaaaccccgggtttaaccccgtttaacggggttaacccggggttaccgggttttaacccggggaacccggggttaaacgggggttaacccggtaaaaggggggttacccgggttaaaaccgttaaaccccggtaaaccgggttaacggtttacgggtaccggtaacccgttccggtaaacccg

SEQ ID NO: 215161 - DNA, 692 bp, Homo sapiens
  misc_feature: GYAE6OF01ENOIS.1.34.D01.1.454.CMB.1.raw
  modified_base (579)..(579): a, c, t, g, unknown or other
  misc_feature (579)..(579): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgctatctagtggagacagacgtcaaccatcaccgttgccgggcgagtcgaggcatcgaggtcgtattctttacggccgttggtgctaacgcaaaggaaaccgaggggaccgtaccgccccgtacgaagtaacgttccggtaagttccgtaagtcgggtacactacgtaccgtaaaggtacgtttacggaaccggtaaacggggggttccggggttaccccctaaggttaccccggtacgggtttaccaggggttacggaccggtagttacggaccgtaagtaccggtacggggaaacctagtaacttaccctacgtcctacgtaactatacgacggtcacgtccgtggacacgtccgtaagtagttatttacgacttaaatttcgtaaccgtntaacaacgttattaacgttaactaccgtacccggttagtcggacgggttccggacgtaagggtaacagggtagaaaccggtaactaaccggtaagtcgggtagcgtagtaacc

SEQ ID NO: 215162 - DNA, 588 bp, Homo sapiens
  misc_feature: GYAE6OF01B6NPN.1.34.D01.1.454.CMB.1.raw
  modified_base (284)..(284): a, c, t, g, unknown or other
  misc_feature (284)..(284): n is a, c, g, or t
  modified_base (340)..(340): a, c, t, g, unknown or other
  misc_feature (340)..(340): n is a, c, g, or t
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
tcagacgagtgcgtcacgaccggtgctcgatttagatcgtctgtgttggggtttgggggagtcagaccctgtcaggacacagcatggacatggacgggtcccccgctcagctccgtggggcctcctgctgctctggctcccaggtaccagctgtgacatccaattcgacccagtcctcccactccctccctgtctgctatctagtggagacagacgtcacctatccacgttcggccgggacgagtcacggccatcgacgtcgtatttcctttagccgttggtcncgagcgaacggaaccgcggggaccaccgcccctagagtatccgtagtctagtggcncatccgtaagtcgtacgacggtacggggtcggtacccagtccgtaggtcgagtcggcagtcgactagtcggtaggactagtactacctctctactactnacgacgctacgctacncgtacgctagtatgttacatttaagtcttacactatacttataacgtactaccggttaccgagttaccggtaccgtcggacgggacggaacggtggtaacgaaccgaccgaacgtcggtaggactgtcgaccc

SEQ ID NO: 215163 - DNA, 899 bp, Homo sapiens
  misc_feature: GYAE6OF01C0FON.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctccgtgggcctcctgctgctcgtggcctcccgaggtaccagctgtgacataccaagttcgacccagtcctccatcctcctgtctgcatctagtggagacagacgtccacctatctaccgttcggccgggaccgtagtaccgacggccacgtcgacggtacgttatttccgttttacgtcccgttaggttcggaccaacgtacgaaacggaaaccggtacgggaccgtacccgccccttagacggtacttaccggttagttacgtagtttcggtacacctacgttaccgaagtagtttcggacggttaacggggtcccggtaacccctacgttacccggtaggttaccgtacgggtcggacgtagtacgcgtaagtcggacggttaacacgttaacttacccgtaccttacctaccgtaacttacgtaccgaagtaccgtccgtccgtacggaccctaaccggtccgtttaaaggacgttttaaccgttttaccggaaacccgtttttaaagtttttaccgttaacgtacccgtttaaaccgtaaaaccggttttacgtttaaccgttttaacgttaaaccccccggtttaaaccccccggtttagggggtaaacccgggggtttaacccccgggggtttttaaaaccccgggaccccggggggttaaaaccccgggggggttaaaaaccgttaacggggggttaaaccttaaaccccggggtaaaacccccgttaaacgggtttacccggaggggttttaccccgggaacccgtttaccggtaaaacccccgg

SEQ ID NO: 215164 - DNA, 841 bp, Homo sapiens
  misc_feature: GYAE6OF01BOSGD.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggcctcccaggtaccagctgtgacatccaattcgacccagtcctccactccctccctgtctgctatcttagtggagacgagacgtacaccagtccacgttcggcccgggcgacgtccgacggcctacgtacacggtcgttacttttccgtttacgtccggttaggttcggacgtacggaccggaacggaaacccggtacggggaccgacccggcccctaacggtacgtacgttacggttagttacgttacggtcgggtacgactacgtaccgaaggtacgttacggaccggtaacggggttccgggtaccctacgttacccgggtaggttcgtacgggtcgacgtaggtacacggtacgtcggtaggacgtacgtaaccgtttaccgtaccttactacgtaactacgtacgacgtaccggtacgtccggtacaccgtcgtacgttaagtaacgtttactttacgtaacttttaatttacgttaacgtacgttaaactaacttagtttaacgttaaccgttacccggttaacccgttacgggttaacccgggttaccggttaaccggggtccgggtaaaccgggaaccggttaaacgggggtaacccgttaaaacggtacccgggtaaaccggttaacggtcgggttaacgggtacgtacccggttaacctaccgtttacgttcccgtaccggttttcctaacccggttccctttaaacccccggtccccctaaccccg

SEQ ID NO: 215165 - DNA, 726 bp, Homo sapiens
  misc_feature: GYAE6OF01CNB66.1.34.D01.1.454.CMB.1.raw
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatggagggtccccgctcagctccgtgggctcctgctgctctggctcccaggtaccagctgtgacatccaattcgacccagtcctccactccctccctgtctgctatctatggagacagacgtcaaccatctacgttcggccgggacgtagtcgacggccatcgagtcgtaactttcgttacggtccgtgggttcgccgacgaccgaaacggaaaacccggnggggaccgaacccgtcccccgtacgtaaggtacgttaccggttaacgtccgttaaggttgggtcaccgtacgttacccgagtacgttacgggacggtaaggggtcccgggtaccctaacggtacgtacgggttaccgaggtcgggactaggtcgactcggtacggtgggaccaacggttactaccctacttaccgacctaacgttacacgacgtacgaacgtccgtacgacctacggtaccgttaaggttaacgtttattttaccgaacttttaacgtttaacttacgttacgtaacttaagtactttaacttacgtaaccgttacccgtaggtacggtaccgttcgggaacccggtaaggggacgtaaggggtacgaaaccgttccggaaacgtacgtgtacggcctacgtacccg

SEQ ID NO: 215166 - DNA, 770 bp, Homo sapiens
  misc_feature: GYAE6OF01CJQ47.1.34.D01.1.454.CMB.1.raw
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccaggtaccagctgtgacataccaattcgacccagtcctccactccctccctgtctgctatctagtggagacagacgtcaaccatctacgttcggccgggcgtagtcgacggccatcgagcgttatttcgttacgccgttggttcgacagaccgaacggaaaccggnggggaccaccgtcccccgtagacgtcgttacggttacgtcgttaggttcgggtacgacctacgtaccgaaggtacgtttacgggaccggttaaacgggggttcccgggtacccctaacggttcccggtaacggtttacgagggtcggacgtaggtcgaccgtagtcggtacgggaactaacgttaacttaccgtaccttaccttacacttactaccgacgtaccgtaccgccgtacgccaacggtacgtaaggtaacgtttactttacggtaacttttaactttaacgttacgtaacgtacttaaacgttagtttaacttaaccgttaacccggttaccccgttagggttacccgggttacccggttaaccgggaccgggtaaacggggtaaccgttaagggggttaccgtaaaaccgggttacccgaaaacgggttcggttagggtaccggccgttaacgtaccccg

SEQ ID NO: 215167 - DNA, 624 bp, Homo sapiens
  misc_feature: GYAE6OF01CJ5PZ.1.34.D01.1.454.CMB.1.raw
  modified_base (270)..(270): a, c, t, g, unknown or other
  misc_feature (270)..(270): n is a, c, g, or t
  modified_base (617)..(617): a, c, t, g, unknown or other
  misc_feature (617)..(617): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccactcctccctgtctgcatctattggagacagagtcacctatctacgttcggccgggcgagtcgaggccatcagcgtatttcttacgccttggttcncgagaccgaagaaaccgaggggaccgacgccccctacgagtactcggtaatctagtggtcgacactaccgagtagttcgacggtaacgggtcgggtaccctagtaccgtaggttcaaggtcggacgtagtcgacgtagtacggtagggactagtacttacacttctactactatcgacgcagcctgctacgcctagtaagtactttagacttaatttataccgtagtactaaacgttattaacttacgtaaacccgtacccgttaggtaccggtacggttaccgggaccggtaacggggaaccgtaagggtacgggtaactacccgtaaacgtacgttggcgtccgngtacccg

SEQ ID NO: 215168 - DNA, 861 bp, Homo sapiens
  misc_feature: GYAE6OF01AXTW4.1.34.D01.1.454.CMB.1.raw
  modified_base (218)..(218): a, c, t, g, unknown or other
  misc_feature (218)..(218): n is a, c, g, or t
tcagacgagtgcgtcacgaccggtgctcgatttagatcgtctgtgttgggtttgggagtcagaccctgtcaggacacagcatggacatgagggtccccgctcagctcctggggctcctgctgctctggctcccaggtaccagctgtgacatccaaattgacccagtctccattccctcctgtctgcatctagtggagacagatcacatcactgccggngagtcaggccatcgagcgtattcgttacgccgtggttcgacagaccgaaagaaaccggacgggaccgaaccgacccccgtagagtagtccggttagtactagtagggtgactaacgtacccgtaaggtaacgtttacggaacggtaacggggttacccgggggttaaccccgtaaccgttaaccccggtaaaccgggtttccggtaaacgggttggggaaccttaaccggggttacggtaacccgttaaaggttcccggttaaagggggttaaacccgtaaaggtaacttttaaaccccgtaccctttaaccggtaaccccttaaacccgggtaatttaacccggaaaccgtaaccggtaacccggtaccctttaccgggccaaacggttcccggtaaagttaaacggttacttttttaacggaacgtttaaacggtttttaaacttaacgttacggtaacttaaaacgttacgtttaaacgtttaaccggttaacccgtaaacccctttaccgggttaaaggggttacccgggtttaaccggggaaccccggttaagggggaaacccggtaaaacggggttacggtaaaagtaacccggttaaaaaccgtacgttaaggggtcggtaacctcgggtaaaccc

SEQ ID NO: 215169 - DNA, 711 bp, Homo sapiens
  misc_feature: GYAE6OF01DIPHB.1.34.D01.1.454.CMB.1.raw
  modified_base (159)..(159): a, c, t, g, unknown or other
  misc_feature (159)..(159): n is a, c, g, or t
  modified_base (219)..(219): a, c, t, g, unknown or other
  misc_feature (219)..(219): n is a, c, g, or t
  modified_base (696)..(696): a, c, t, g, unknown or other
  misc_feature (696)..(696): n is a, c, g, or t
  modified_base (702)..(702): a, c, t, g, unknown or other
  misc_feature (702)..(702): n is a, c, g, or t
tcagacgagtgcgtcacgaccggtgctcgatttagatcgtctgtgttgggtttgggggagtcagaccctgtcaggacacagcatggacagtggacgggtcccccgctcagctccgtggggctcctgctgctcgtcggcctcccgaggtaccagctgtanacactaccaacttcgaccctagtcctcctactccctcctgtcctgctattcgtagtgganacgagacgtccactactccgtacgtcggccgggacggtacggcgacggactaactcgacgtcgtaactttcgtttacggcgttggtcgacgacggacgaaacggaaccggacgggaccgacccgtaccccgtagaacgttacgtacggttacgtacgttacggtgtcgaactacgtacctaggtacgttacgggtaacggtcgggggttaccggtacccgtaaacggttcccggaggttacgtacggtacggtacgtaggtacgacgtacggttaccgggacggtaacgtacgttaacgtaaccttacctaccgttactaacttaacggaccgacgtaccgcgtaccgtaggacgtacgtacgtagtaacgtttcttaatacgtttacttaacgtcgtacgttaacacgttaattcgtaacgtcccggttacgcggtaacgtcggtacggaacggtaggacgtaggacagacgtagntacggntcgctaccg

SEQ ID NO: 215170 - DNA, 666 bp, Homo sapiens
  misc_feature: GYAE6OF01EZE7N.1.34.D01.1.454.CMB.1.raw
  modified_base (659)..(659): a, c, t, g, unknown or other
  misc_feature (659)..(659): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgctatctagttggagacagacgtcaccatcacgttcggccgggcgagtcgaggccaatcgagcgtactttcgtttacgccgttggttgcgagaccaaggaaaaccggacggggccgaccgcccctagacgtacgtcggtagttctagtggtacgcacgtcagtacgtggcggtaaggggtcggtaccctagtccgtacggttcgacggtcggcgtagtacgtactacgttcggtagggtaacgtacgttaacttaccgacttctactaacttactacgacgtacgacgcctacggacctacgtcgtaaggttaactttcgtttactaacgtttaagtttttaccgtacgttacgtaacctaaagttagttaacttaccgttaccgttaccgttacggttacggtacccggttcgggaccgggtaagggaccgtagggtaacggtacgtaccgtaacgacgttaggtcggtcngtacccg

SEQ ID NO: 215171 - DNA, 788 bp, Homo sapiens
  misc_feature: GYAE6OF01E05FI.1.34.D01.1.454.CMB.1.raw
  modified_base (572)..(572): a, c, t, g, unknown or other
  misc_feature (572)..(572): n is a, c, g, or t
tcagacgagtgcgtcacgaccggtgctcgatttagatcgtctgtggttgggtttgggggagtcagaccctgtccagacacagcatggacatgacgggtccccgctcagctccgtggggcctcctgcctgctcgtcggacctcccgaaggtaccagctgtacgacactaccctaattcgaccctagttcctcctactccctcctgtcctgctattctagttggagacagtagccaccaatctaccgttcggcccgggactacggtcgacggcctacgtaccgaggtccttacgttttccgttacggtccgttggtttccggacaacggaaccgaaacggaaacccggagggacccgacccggtccccctacggacgttaacgtcgtagttccgtaggtcggtcacctacgtaccgagttaacggttcgaacggtacggggtaccggttaacccctacggtccgtaaggtttccggaaggtcgtacgtacggtccgtagtaactcgggtaacggactaacgttacctaccgacctccgtactactacgtacacgtacctacgtccgtacgaccncgttaaccgtagttaagtttactttccgtaagtttaacttttaacgacccgtttataaccgttaaagttactttaactttaccggtaaacccgttacccgttaccgggttaacggtacccggttaccggggtaccggtaaacggggcccggtaaaaggttaccccgggaactaacccgggtaacgttaccggtagggtacgtacccgtacggaccc

SEQ ID NO: 215172 - DNA, 836 bp, Homo sapiens
  misc_feature: GYAE6OF01B8TD0.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtgggctcctgctgctcgtggctcccaggtaccagctgtgacatccaattcgacccagtcctccactccctcctgtctgctattctagtggagacagagtaccaacctatacctacgttcgggcccgggacgtaggtccgacgggcccagtccgaggtcgttacttttcgtttacggccgttgggttgaccgtaaggaccaaacgggaaacccggagggggaccccgtaaccgtcccccctagaacggtacgttaccggttaacgttcgtaaggttcggggtactaccgtaactacccggaagttacgttacgggaaccgggtaacgggggttccgggtacccctaggttacccggtaggttcgaagggtcggacgtagggtcgtacgtacggttccggtacgggtaacctaggttaaccttacccgacgtttacctaactaaacgttcgtaaccgacgtaaccgtacgtccgtagtaccggtaacgttacgtttaaggtaattttacgtttaacttaactttaaacgtttttacgttaacgttacgttaaccgtaaacgtttaggttaaacctttaccgttaacccggttaccccggtttagggtacccggttacgggttacccgggacgggtaacgggtaaaccggtaaggggttaaccgtaaacccggttaaacccggtaaaccggttacggttccgggtacggtccgtaaccggtaaccccg

SEQ ID NO: 215173 - DNA, 721 bp, Homo sapiens
  misc_feature: GYAE6OF01CH550.1.34.D01.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
tcagacgagtgcgtcacgaccggtgctcgatttagatcgtctgtgttgggtttgggggagtcagaccctgtcaggacacagcatggacatgacgggtcccccgctcagctcctggggctcctgctgctctggctcccaggtaccagtctgtgacataccaattcgacccagtcctccactcctccctgtctgcatctagtgganacagacgtccgacatctacgttcggccgggcgagtcgacggccatcgagcgtattctttagccttggttgctagacaacggaaaccgagggccgaacgcccccgtanaacgtactcggtagtctagtggtgacactccagtagttacgacggtaagggtccggtaccctagtacccggtaggttacgaggtcggactaacggtactaacgttacggtacgggaacaacggttaacttaaccgtaccttactaccgtaactacgttaccaacgtccaccgttccgacgaccgtacgtacccgtaaggttaacgtttattttcggaacctttaaattttacttaaccgttacggttaaactaaccgttaatttaaacgtttaaccgtaacccggtttaaccccggtacggttaccgggtacccggtttaccgggacccgggtaaccggggtaccggttaaacggggtaaccgtagtaacccgtaaaccggtaacggttcggagtacctgaccgtaaccg

SEQ ID NO: 215174 - DNA, 814 bp, Homo sapiens
  misc_feature: GYAE6OF01BP4N9.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccactccctccctgtctgcatctattggagacagagtcacatcacgttcggccgggcgtagtcgaggaccatacgagacgtactttcttacgccgttggttcgcagacaacggaaacccgaggggccgaccgcccctagaacgtacgttacggtagttcgtaggtcggtcgacctacgtacccgtaagtacgtttcgggaacggtaaccgggggttccgggtacccctacgttacccggtaacgggtttcaacgggttcggtacgtacggtagaccgtaagtcccgggtagggaacctaaagttaaccgtttacaccgttaccgtactaacgtacgtaccgtagacccgtaccgtccggtacgtaccgtaccggtacgtttaaggtaaacgttttcgtttacggtaaactttaaggttttaacctttaacggtacttaaaccgttaacgttaacgttttaacgtttaacccgttaacccggtaaaccccggtttcgggttaaccggggtaccggttaccggtaacccggggaacgggttaacccggtaggggttaaccgaaccgtaacccgtaaacggtaccggttcggtacggtaccgtaccgtctaacccgtacgttacgtttaccgtaccctttacccgacccctttcccgttccccctacccccg

SEQ ID NO: 215175 - DNA, 647 bp, Homo sapiens
  misc_feature: GYAE6OF01DEN3T.1.34.D01.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (469)..(469): a, c, t, g, unknown or other
  misc_feature (469)..(469): n is a, c, g, or t
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattcgacccagtctccactccctccctgtctgcatctatgganacagatcacatcacttggccggngagtcagccatcagcattcttagcctggtgcagacaagaaaccgngggccgaccgcccctnagtactcggtatctagtcggtagctatccgagtacgtgaccggtaaggggtccgggtaccaagttcccgtaggttacgaggttcggactagtcgactagtcggtaggggactaaggtacttaaccgacttcctacacttagtacgtagacctacggcctacgactacggtacttagaaacgtttntttacgaacgttttaatttacgttacgtacgtaactaaacgtagttaacctttacgttaacccggtacccttagggaccggtttaaccgtaccggggacgtaacgggggaaacccttagggggtaaccgaaacggttaccaaaacccgggttagttaggtccgggtctaccggtaacc

SEQ ID NO: 215176 - DNA, 621 bp, Homo sapiens
  misc_feature: GYAE6OF01DWFSV.1.34.D01.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (432)..(432): a, c, t, g, unknown or other
  misc_feature (432)..(432): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatccgtccctgtctgcatctattgganacagatcaccatcacttggccgggcagtcaggcatccagcgtattctttagccttggttgcagcagaaaccgagggccacgcccctanagtatcgtagtctagtggtgaccatccagtattcggacgtaaaggggtcgggtaccctacgtccgtaggttctaaggtgggactaggttcacgtaagtcggtagggacctaagtaacttacacttctacactatcgagcacgtccngacacgtccgtagtacgttagttttacaagttaatttttaattacctaaggttacaaagttaggttaacttacgttaaccggtaccccgtttaacgggtcggtaccggttacccgggaccggtaaagggaccgttaaggggaccgtaaacggtaccgtaaaccggtacgtggtccggtgtcgtaacccg

SEQ ID NO: 215177 - DNA, 853 bp, Homo sapiens
  misc_feature: GYAE6OF01CGRU8.1.34.D01.1.454.CMB.1.raw
  modified_base (154)..(154): a, c, t, g, unknown or other
  misc_feature (154)..(154): n is a, c, g, or t
  modified_base (371)..(371): a, c, t, g, unknown or other
  misc_feature (371)..(371): n is a, c, g, or t
  modified_base (650)..(650): a, c, t, g, unknown or other
  misc_feature (650)..(650): n is a, c, g, or t
tcagacgagtgcgtcacgaccggtgctcgatttagatcgtctgtggttggggtttgggggagtcagaccctgtcaggacacagcatggacatgacgggtccccgctcagctccgtggggctcctgctgctcgtggcctccgagtaccagctgtnacactacactcgacctagtctccactccctcccgtgtctgctacttacgtagttagggaacgaacgacgtacgtaccaaccgtactaccgttaccggttcgggaccggggacggtacggtaccgacgggaccttaagccgtaacgggtctttaacttttaccggtttcggtaccggttgggttacgacgaacggtaccgaaaacgggaaaccccggnggggaccgtaaccccggtcccctaagtaaagggttacccgttacggtttaccggtacgttaacgggttcccgggttacaaccccgtaagtacccggttaaacggtgggtttacgggaacccggggtttaaccgggggtttccgggggttaacccctaccggtttaacccggggttaaggggttacccgaagggttaccggggctaacggggttacaccggttacggtttacgggaaacggtactaacggtaaccttactacgtacctaactacgttacncgtacacgactccgtagactaccgtacgtaacgtacgtttatttacgtaactttaagttacttacgttagtaaccttaattacgtttaactacggttaacccgtaccggttacggtacgggtaccggtacgggtaccggaacggggtaacgtacggggtaacgtaacgaccgtaacggtacggttacggcgtacgtcgtaccg

SEQ ID NO: 215178 - DNA, 697 bp, Homo sapiens
  misc_feature: GYAE6OF01BN7MR.1.34.D01.1.454.CMB.1.raw
  modified_base (453)..(453): a, c, t, g, unknown or other
  misc_feature (453)..(453): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctagttggagacagatcaccatcacgttcggccgggcgagtcaggccaagtcaggacgtacgtttacctttagccgttgggttgactagacaacggaaaccgaggggccgacgcccctgagtactcgtagtctaagtggtcgctactcctagtattaggacggtaaggggtccgggtccctaagtcccgtaagggtttcaggttgggacgtagtcgactagtccggtagggactaacgtacttacaccgttctactaactanaccgtagacgtaaccgtccgtagccgtacgtacccgttaagtaacgtttattttacgtaactttaattttacctttaacgtacgttaactaaacgttaagtttaacttaacgttaacccgttaaccccgtacgggttacggttaaccgggttaccgggtacccggtaacggggtaaccggtaagggttaacgggaaacggttaaccgaacccggttacggttagggtcgtccgtcggtaacccg

SEQ ID NO: 215179 - DNA, 740 bp, Homo sapiens
  misc_feature: GYAE6OF01BGKPP.1.34.D01.1.454.CMB.1.raw
  modified_base (247)..(247): a, c, t, g, unknown or other
  misc_feature (247)..(247): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttcgccgggcgagtcaggccatcagcgtatttctttagcctggttgcagcagaaaccgngggacgacgccctgagactcgtagtctagtggtgcatccagagttggacgtaaggggtcgggtaccacgtccgtagggttctaggtggacctaggtcgactagttcggtacggggaactaaggtaactttaaccgacgttacctacgtaaacttaacgtaccgaacgtccgaacgtccgttacggaccgtagtcccggttaaagttaacgttatttttaacgaacttttaagtttttaccgttaacgttacgttaacgtaaacgtttaagtttaaacgtttaacgttaacccggttaacccccggttaagggtttaccgggaccgggttttaccccggggacggtaaacccggggggtaacgtaaacggggtacggtaaaaccggttaccggtaaaaccggtaacggttggggtacggtaccgtaccggtcctaaccggtacttacccggttacgttcttaacccgttcccttaccccggtccccgtaacccg

SEQ ID NO: 215180 - DNA, 658 bp, Homo sapiens
  misc_feature: GYAE6OF01CLDYY.1.34.D01.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggctcccgaggtaccagctgtggcatccaattcgacccagtctccatccctccctgtctgctatctattggagacagagtcaccatcacgttggccgggcgagtcacggccatcagtcgtatttctttacgccttggtgcaagcaaacggaaaccgnggggaccaccgcccctagagtacgttacggtacgttctaggtcgggtcactactaccgagtagttggacggtaaggggttccgggtacccctaactcccgggtaggtttacgagggttggaccgtagtacgaccgttaggtcggtaagggaactagtaacctttaaccacttcctactaacctactaccgaacgtcacgtccctagaccgacggtcctaaggtaacgtttatttacgactttaatttatacctattactaattaagttaacttactacccggttaacccgtaggtaccggtacgttaccgggaccggtaagggaccgtaaagggtacgaacgtaccgaacgtacgtggcgtcgtacggacc

SEQ ID NO: 215181 - DNA, 776 bp, Homo sapiens
  misc_feature: GYAE6OF01A8GW4.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggcctcctgctgctcgtcggcctcccgaggtaccagctgtagactactacctaattcgaccctagtcctccacttccctccctgtctgctattcttagtaggaagacgagtacgtaccactactcctacgttcggaccggggacgacgtaccgacgcctagtaccgagtcgttactttcgtttacggtcgttggtcacgacgacgaaacggaaccggacggggaccaccgtccccgtagacgttacgttaccggtatacgtagtggtacactaactaccgtaagtgttacggaacggtacggggttccggacctagtacggtacggttcgaggtcgagtagtcgactaggtacggtaggactactaccttacaccttactacgttaacctacgtaacgaccgacgtaccggtccgtaaggccgttaaccggtcgttaagttaacgttttacgtttaaccgtaattttaacgtttaacgttacccgtaacgtaacgttaaacgttagtttaaaccttaaccgggttacccgttaaccgggtttaccggttacggtacccggggttaccggaaccggggtaacggggttaacggttaagggtaaccccgaaacgttaccggtaaaccggttacggttacggtacgtaccgtccggtaacccg

SEQ ID NO: 215182 - DNA, 556 bp, Homo sapiens
  misc_feature: GYAE6OF01AORGE.1.34.D01.1.454.CMB.1.raw
  modified_base (102)..(102): a, c, t, g, unknown or other
  misc_feature (102)..(102): n is a, c, g, or t
  modified_base (195)..(195): a, c, t, g, unknown or other
  misc_feature (195)..(195): n is a, c, g, or t
  modified_base (352)..(352): a, c, t, g, unknown or other
  misc_feature (352)..(352): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgntcagctctggggctcctgctgctctggctcccaggtaccagctgtgacatccaattgacccagtctccatcctccctgtctgcatctatgganacagagtcaccatcacttgccgggcagtcaggccatcagcgattcttagcctggttgcagcagaaccgagggccacgccccgtcagactcgtagtctagtggtgcatcagtgttgcgaggtcgggtcccatccgaggttcaggtgcagtgcagtcgngggacagacttacgactctacactatcagtcacgcctgcagtcctagaagtntttcgacttaatttacttactgtaacctaagtagttacttacgtaccgttaccccgtaggttacgggaccgtttaccgggaccgtagggggaaccctaaggggttacggaacgttacccgtaaaccggtacgtggttccggcgttcggaccc

SEQ ID NO: 215183 - DNA, 767 bp, Homo sapiens
  misc_feature: GYAE6OF01EKHVJ.1.34.D01.1.454.CMB.1.raw
  modified_base (260)..(260): a, c, t, g, unknown or other
  misc_feature (260)..(260): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatccctccctgtctgcatctagtggagacagagtcacctatcacttggccgggcgagtcaggccatcagcgtattcttagcctggttncagacgaagaaaccgagggccgaccgcccctacgagtagtacggtagtctagtcggtagctactaccgagtagttggacgtaacggggtcgggtaccccacgttaccggtagggttacgacggtgggaccgtaaggtcgctaaggttccgtaaggggtaactaacggtactttaacccgaccctttacgtacctaactttacgaccgaacggtacccaacggtccccgtacggtccgtaacgggtaccccttaagggtaaaacttttacgtttttacgaaacttttaacgttttttaacctaacgttagttaaacccgttaaaactttaaggttttaactttaacccgttaaacccgggttaacccccgttacggggtttacccgggtaaacccgggtttccggggaaaccccggggtaaggggtaaaccccgggttaaagggtaaccgggtaaaccgttacccggtaaaaccggttacggtaacggtcggaccgttagaaccccgg

SEQ ID NO: 215184 - DNA, 634 bp, Homo sapiens
  misc_feature: GYAE6OF01CKYVN.1.34.D01.1.454.CMB.1.raw
  modified_base (289)..(289): a, c, t, g, unknown or other
  misc_feature (289)..(289): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccactccctccctgtctgcatctagttggagacagagtcaccatcacgttcgccgggcgagtccaggccatcagcgtatttcgtttacgccttggttcgcacgacaacggaaaaccgnggggaccgacgcccctacagtactcgtagtctagtggtcacataccgagtagttggacgtaagggtcggtaccagttccgtaggttcaggtcggctaggtcgactagtccgtagggactagtacttacgacttctcaactatacacgcacgcgtacgacacgtaccgtagttaaaggttctttagtaactttagttttaactacgtacgtaactaaagttacgttaacgtttacgtaacccggttaccgtacggtaccggtaccggtaccgggtaccggtaacgggaacgtaaacgggtacggaaaccgttacgaaaccggttcgtaggtcgcccgttagacccg

SEQ ID NO: 215185 - DNA, 667 bp, Homo sapiens
  misc_feature: GYAE6OF01DFAQV.1.34.D01.1.454.CMB.1.raw
  modified_base (104)..(104): a, c, t, g, unknown or other
  misc_feature (104)..(104): n is a, c, g, or t
  modified_base (256)..(256): a, c, t, g, unknown or other
  misc_feature (256)..(256): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (488)..(488): a, c, t, g, unknown or other
  misc_feature (488)..(488): n is a, c, g, or t
  modified_base (516)..(516): a, c, t, g, unknown or other
  misc_feature (516)..(516): n is a, c, g, or t
  modified_base (538)..(538): a, c, t, g, unknown or other
  misc_feature (538)..(538): n is a, c, g, or t
tcagacgagtgcgtcacgaccggtgctcgatttagatcgtctgtgttgggtttgggggagtcagaccctgtcaggacacagcatggacatgacgggtcccccgntcagctccgtgggcctcctgctgctctggcctcccgagtaccaggctgtcgactacttaccaatttcggaccctagtcctaccacttccccttccctgtctcgctattctagtcgggacacgagtactaccacctatctacgtcggcccggngacgtcgacgcctatccgagtcgtacttcttacgctggtcgcagaccaacggaacgnggccgtaccgccccgtnacggtctccgtacgtcgtaagtggtacgctacgtccagtacgttcgacgtacggtccggtaccacgtccgtacggtcgaggtcgtacgagtgacagtacggaggtactaagtacttacctacgttacctctaacgtagaccacggtaccaccggttcncgtaccgtacgtaccgttagtaacgttntttacgtaacgttacttttaanaccgttagtaacctaagttacttaaccttacgtaccggttaaccgttccgggtagtaccggttaccggaccggaaaggtacgtaacgggtagaaaccggttcgaaacgtcgtagtccggctacgtaccg

SEQ ID NO: 215186 - DNA, 865 bp, Homo sapiens
  misc_feature: GYAE6OF01B7C1W.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctctggcctcccgaggtaccaggctgtagacataccaattcgaccctagtcctaccactccctccctgtcctgctatctagtggacgacagactaccaacctactactacgttcggaccggggtacgtacggtaccgacggaccctaagtcccgaggtaccggttattttaccgttttagggtcccgttggggttcgaccgaacggaaccgtaaaccgggaaaacccggcgggggacccctaccggcccccttaagaaccggtacgttaccggttacggttacgttaggttcgggtacctactaaccgtaccggtaagttacggttacggaaccggttaaccgggggttccggttaccctacggtaccggttagggtccagggtccgagtacggtcgacctagtcgggtacggtaactaacgtactaccgtacctctactaactacgtacgacgcgtacgtccgtacggacgtaaccgtaccggttaagtaacgttttcgtttaacgtaacttttaacgtttacgttaaccgttacgttaaaccgttaaaccgttagtttaaccgttaccgttaaccccgttacccggttacgggttacccgggtacccggggtttaccgggaaccccgggtttaacgggggaaacccgggtttaaacgggtaaccgggttaaaccctaacccgggttaaacccgggttacggtacgggttaacccggtacccgttccgtaaccccgg

SEQ ID NO: 215187 - DNA, 729 bp, Homo sapiens
  misc_feature: GYAE6OF01EZBD9.1.34.D01.1.454.CMB.1.raw
  modified_base (101)..(101): a, c, t, g, unknown or other
  misc_feature (101)..(101): n is a, c, g, or t
  modified_base (229)..(229): a, c, t, g, unknown or other
  misc_feature (229)..(229): n is a, c, g, or t
  modified_base (343)..(343): a, c, t, g, unknown or other
  misc_feature (343)..(343): n is a, c, g, or t
  modified_base (541)..(541): a, c, t, g, unknown or other
  misc_feature (541)..(541): n is a, c, g, or t
tcagacgagtgcgtcacgaccggtgctcgatttagatcgtctgtgttgggtttgggggagtcagaccctgtcaggacacagcatggacatgagggtcccgntcagctccgtgggctcctgctgctctggcctcccgaggtaccagcttgtagactactacgtaattcgacctagttcctcctacttcctcccttgtctcgactattctagtggagactagctaccaacnctcgtacgttcggaccggtcgtacgtccgacggtaccacgtcgagtcgttactttacgttacgcgttaggtcgacacgacgaaacggaaccgcgggaccgtacccgcccgtaanacggtacggttaccgttagttcgtacgtgggtacctacgaccgttacgtagtcgtaacgggaccggttaggggtcccggtaaccctagttacccggtaggttcggaacggttcggaccgttaggtcctagtaccggttacggtaacgggaacgttaacgttaactaccgtactaccgtactacgtactacgcgtaacncggtctcgactacgtacggttatagtttctttaagtacttaacgtttacgtacgtactacgtaattacgttaacttacggtaccgttaccgttacggtacggttacgtaaccgggtaccgtacgggtaacggttaacgggacgtaacgaaacccgtacggtaacggttcgaacgggttccacgtaccg

SEQ ID NO: 215188 - DNA, 685 bp, Homo sapiens
  misc_feature: GYAE6OF01AO29K.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagagtcaccatcacgttcggccgggacgagtcacggccatcgagctatttctttacgccgttggttcgcagacaacgaaaccgngggaccacgcccctagagtactcgtagtctagtggtcacataccgagtacgttcggacggtaacggggtcgggtaccctacgtccggtaaggttccgagggtcggacgtacggtcgacgtacgtcgggtacggtaactagttactaccgtacttcgtactacgttacacgacgacctacgccgtcgaactaccgtacgtagtaacgtttctttacgtaactttaagtttacttacgtagtaacgttaacgtaagtttaacttaccgttaacccgtacccgttaggttaccgggtaaccgggttaccggaaccgggtaacggggtaacggtaaacggggttacggtaaaaccggtaacccgtaaacggttacggttagggtacggtaccgttcgtaacccg

SEQ ID NO: 215189 - DNA, 695 bp, Homo sapiens
  misc_feature: GYAE6OF01CP8ZK.1.34.D01.1.454.CMB.1.raw
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacactccaattcgacccagtcctaccactccctccctgtcctgctattctagttgganacaggacgtaccaccatccacgttcggccgggtnaagtcgaggccagtcgagtcgtatttcgttacgccttggttgacagcaagaaacccgngggccaacgtccccctgaagtcgtacgtagtactaggtcggtcgacctacgtccgaggttacgttcggaccggtaacggggttccgggtaacccctacgttacccggtagggtttccgaagggttccgggactagggtcgacgtacggttcggtaacggggaacctaggttaaccttaccacccgttacgtaccctaacgtactaccgagtccgaccgtccgtgaccgacgtactaggtaaactttgtttacgaactttaagtttactaccgttaagtaccaattaagtttaacttacgtaccggttaacccgttggaccggttccggttaccggacggtacgggtaacctaggggtagaaccgtccgtaaaccggtatggtacgcgtacgtacc

SEQ ID NO: 215190 - DNA, 739 bp, Homo sapiens
  misc_feature: GYAE6OF01ESL51.1.34.D01.1.454.CMB.1.raw
  modified_base (216)..(216): a, c, t, g, unknown or other
  misc_feature (216)..(216): n is a, c, g, or t
  modified_base (366)..(366): a, c, t, g, unknown or other
  misc_feature (366)..(366): n is a, c, g, or t
  modified_base (597)..(597): a, c, t, g, unknown or other
  misc_feature (597)..(597): n is a, c, g, or t
  modified_base (715)..(715): a, c, t, g, unknown or other
  misc_feature (715)..(715): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggcctcctgctgctcgtcggcctcccgaggtaccagctgtagacataccaattcgacccagtcctccactccctccctgtctgactatctagttggganacgagtactccacatcacgttcggccgggcgacgtcgacggacctatacgagtcgtactttaccgttacgccgtggttcgactaggaccgaaacggaaaccggcgggtaccaccgcccctagtagtacgttaccgattcgtagtcggtancgtactaccgagtatacggaacggtacggggttccggccttaagtccggtacggttacgaggtcggacgtaggtacccgtagtaacggttacggacgggtaaactacgtaacttaccctacggttctaacgtactacgttaacgaacgccgtaaccggtccctaggacccgtacgttacggttaagtaacggttttacttacgtaacgttttaaacttacgttaacccgtnttaaaccgttaagtaacggtttaaccttaacgggttaacccgggtacccgtgggttaaaccggtacccgggacgggtaaaccgaagggttacggaagggttacgaaccgtaaacccgngtaacgtcgggcgactggtaaccc

SEQ ID NO: 215191 - DNA, 965 bp, Homo sapiens
  misc_feature: GYAE6OF01BOWH9.1.34.D01.1.454.CMB.1.raw
tcagacgagtgcgtcacgaccggtgctcgatttagatcgtctgtgttggggtttggggagtcagaccctgtcaggacacagcatggacatgagggtccccgctcagctcctggggcctcctgctgctctggctcccaggtaccagctcgtgaccatcccaattcgacccagtcctccatccctccctgtctgctagtctagttcggaagtacacgagtccaccatccaacgttcggacccgggtcgaagtcgacggccctagtcgaacgacggtatttcgtttacgtcccttgggttcgacctagaccaacggaaaccgaggggaccgaaccgccccccgtacgaacgacgttaccggtaattcgtaactgggtcgacctactacccgtaaggtacttggaccggtaacggggtcggggttacccctaagtacccggttacgggttaccgtaacgggttcggtaccgaaggttcggtaaccgtacgttaccggtaacggggtacttaaccggtaacttttaaacccggacctttaccgtaccgttaaccggttacttaacccggaacggtaaccgtaccggtacccgttaccggaaccgttaaccgggtccctttaaggttaaacggttttaacctttttaagggttaacccttaaaacgttttttaacccgtttaaacccgtaccgggttttaaaacctaaaaccgtttaaacgggttaaccgttttaaaccccgttaacccgggttttaaaccccccgggttaaacgggtttttacccgggggttaaaaaccccgggttttccgggggttaaaacccccgggggtaaacccggggtaaaaccccgggggtttaaacgggggtacccgggttaaaaaaccccggttcccgttaaaaacccccgggggtttaaggttaccccggggtttaaacggttcccggttaaaacccgggttaacccccgg

SEQ ID NO: 215192 - DNA, 821 bp, Homo sapiens
  misc_feature: GYAE6OF01CCR87.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctctggctcccgaggtaccagatgtgacataccaattcgacccagtcctccactccctcctgtctgctatctagtggagacagacgtcaccatcctacgttcggcccgggacgacgtcgacggccatcgagtcgtatttccgtttacggccgttgggttacgacgtacggaccgaaacggaaaaccggacgggggacccgaacccgtcccccgtacgaacggtacgttacggttaacggtcttaggttgggtacactaacttaccgaagtacgttacggacggtaacgggggttccgggtaccctaagttacccggtaacgggttcgaaggtcgggacgtacggtacgtactacggtacggtacggggaactaacgtaactttaaccgaccttacctaactaaccgttactacgaaccgacgtaccgtccgtacgaccgtaccgtccgttaagggtaacgttttaacgtttttaaccggaacttttaaacgttttacgttaacgttaacgttaacctaaaggttaacgttttaacgtttaaccggttaacccgttaaccccggtttacggggttaccgggtaacccgggttaccgggaaacccgggtaaggggggaaacccttagggggttaacccggtaaaccggtacccggtaaaccggttagttaccgggttacggaccgtacgtaacccg

SEQ ID NO: 215193 - DNA, 576 bp, Homo sapiens
  misc_feature: GYAE6OF01AD2D1.1.34.D01.1.454.CMB.1.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (397)..(397): a, c, t, g, unknown or other
  misc_feature (397)..(397): n is a, c, g, or t
  modified_base (473)..(473): a, c, t, g, unknown or other
  misc_feature (473)..(473): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (543)..(552): a, c, t, g, unknown or other
  misc_feature (543)..(552): n is a, c, g, or t
  modified_base (554)..(576): a, c, t, g, unknown or other
  misc_feature (554)..(576): n is a, c, g, or t
tcagacgagtgcgtcacgaccggtgctcgatttagatcgtctgtgttgggtttggggtaggtcgaggccatcagcgattctttagtcctggttgcagcagaaaccgaagggcggacgcccctccacgatcgtagtctatggtgcatccagattgcgaaggtgggggtcccgactccaggttcagtggcagtgcatctagggacagaattacacctctccaactntaccagtcaacgtccngccacgtcctacgaagtattttgacttaattttacttacagttaccaacgtaagttaattacgttaccgtaccccgtagttacgggtaccgttaccggtcccgggaaggggaaccgtaacgggtaaggtaacgtaccgaaacccgtaacgttacggnggtcttacgactaccctagttaccgtcttcgttacctaccttcccttacccccctaccccgtaccctccgtaaccnctacccgtacgtccgtaggccggcggtaaccggtcgtaccgacggtacggccaatccggntacngcnacnnnnnnnnnncnnnnnnnnnnnnnnnnnnnnnnn

SEQ ID NO: 215194 - DNA, 980 bp, Homo sapiens
  misc_feature: GYAE6OF01CI5HJ.1.34.D01.1.454.CMB.1.raw
  modified_base (103)..(103): a, c, t, g, unknown or other
  misc_feature (103)..(103): n is a, c, g, or t
  modified_base (131)..(131): a, c, t, g, unknown or other
  misc_feature (131)..(131): n is a, c, g, or t
  modified_base (182)..(182): a, c, t, g, unknown or other
  misc_feature (182)..(182): n is a, c, g, or t
tcagacgagtgcgtcacgaccggtgctcgatttagatcgtctgtgttggggtttgggggagtcagaccctgtcaggacacagcatggacatgagggtccccgntcagctccgtggggctccgtgctgcctntcggctcccaggtaccagcttgagacataccaattcgacccagtcctaccnctccctcctgtctgctacgtctagtggacgacagactacaccagttaccacgttcgggacccgggacggtagtaccgacgggaccctagtacccgtaagggtccgtttaacttttccgttttaacgggtcccggtttggggtttaccgaacccgtaagggacccgaaaaaccggtaaaccccggggaagggggacccccgaacccgggtaccccccctaaagtaagggttaacccgtttacccggtttaaaggttcccgtttagggttacgggtacctacgttaaccgtaccgggttaaacgttaacggtttacggaaccgggttaaacgggggttccccggggttaaccctaaccgtttacccgggttaagggtttaccgaggggtacccggttaagacgggtttaacgaccgttagggtacccgggttaaaccggggaattaaccgggtttactaaccggttaaccttcctaacgtaacgttactaccggaacgtaccgtacgccggttaacaccgtacggtactaacggttaacgtttagttaacgtaacgttttaacctttacgttaccggttaaactaacgtttaaaccgttagttaaaacgtttaccccgttaacccgggttaaaccccggttacgggggttaaacccggttaccggggttaaccccgggtaacccggggtaaagggggtaacccccggttaaagggggtaaacccgggttaaacccggtaaacccggttaaccgggtacggtttaacccgggtccggttaaccgttaccggttaaacccgg

SEQ ID NO: 215195 - DNA, 803 bp, Homo sapiens
  misc_feature: GYAE6OF01CJ057.1.34.D01.1.454.CMB.1.raw
  modified_base (105)..(105): a, c, t, g, unknown or other
  misc_feature (105)..(105): n is a, c, g, or t
  modified_base (150)..(150): a, c, t, g, unknown or other
  misc_feature (150)..(150): n is a, c, g, or t
tcagacgagtgcgtcacgaccggtgctcgatttagatcgtctgtgttgggtttgggggagtcagaccctgtcaggacacagcatggacatggacgggtcccccgntcagctcgtggggctcctgctgctcgtcggcctcccgaggtaccngctgtgacataccaattcgaccctagtcctccactccctccctgtctcgactattctagtggacgacagtacgtacacatccgtacggttcggccgggagacgtccgacggacctatccgacgtcgttactttcgttacggtccgttaggtacgacgacgaaccgaacggaaccggacgggaccgtaacccgtccccgtaagtaacggttacgttaccggttaacgttcttaagggttgaccggtacctacgtaccgtaggtacgttacggggaaccggttaacgggggtcccgggttaacccgaggtttacccggggtaggttaccgtaagggtaccgggtaacggtagggtaccgtacgttaacggttacgggtacgtaaactacggttaacttaaccgtcccgttactaacttaccgtaccgtacgacgtcgtaccgtccggacgtaccgtacgtaccgttaagtacgttttaactacgttaacttttaacgttacgttacgtacgtaacttaacggttaactttaccgttacccggtacgttaacccggttacgggtcccggtaacggttccggggaaacggtacggggtaccgtaagggtacccaaacggttacccgtaacgtaggtaccggtcaccgggtgtacccg

SEQ ID NO: 215196 - DNA, 525 bp, Homo sapiens
  misc_feature: GYAE6OF01D70PR.1.34.D01.1.454.CMB.1.raw
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
  modified_base (460)..(461): a, c, t, g, unknown or other
  misc_feature (460)..(461): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (493)..(494): a, c, t, g, unknown or other
  misc_feature (493)..(494): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
  modified_base (508)..(509): a, c, t, g, unknown or other
  misc_feature (508)..(509): n is a, c, g, or t
  modified_base (513)..(513): a, c, t, g, unknown or other
  misc_feature (513)..(513): n is a, c, g, or t
  modified_base (516)..(517): a, c, t, g, unknown or other
  misc_feature (516)..(517): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagacttacactctcactatcagcacgcctgccagtcctagaacgttattttcgactaattttatacgtggtaccaacgtagttattaacgtaccgtacccgtaggtcggtacgtcggaccgaaggggaccaagggtgaacgtccaaccggtagtgtacgctcgcactatctgttcctcacttccctcccacctctcgaacgcctacgtccgtacgtgaccgggtcggtacgtcggacctaggtcccgacgtagtacggctncgtacgngtacnngtcangngncgcgcgcgcntnctngngncngnngtcgctgngtcncnncgcncgnngngngtcg

SEQ ID NO: 215197 - DNA, 663 bp, Homo sapiens
  misc_feature: GYAE6OF01C9RDS.1.34.D01.1.454.CMB.1.raw
  modified_base (302)..(302): a, c, t, g, unknown or other
  misc_feature (302)..(302): n is a, c, g, or t
  modified_base (651)..(651): a, c, t, g, unknown or other
  misc_feature (651)..(651): n is a, c, g, or t
  modified_base (657)..(657): a, c, t, g, unknown or other
  misc_feature (657)..(657): n is a, c, g, or t
  modified_base (660)..(660): a, c, t, g, unknown or other
  misc_feature (660)..(660): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatcaaccccttgacccagtctccactccctccctgtctgctatctagtggagacagacgtcaacctatcctacgttcggccgggcgagtcacggccatcgagtcgtatttcgtttagccgttggttcgacaacggacgaaacgaaaaccgnggggccgaccgtcccccgtagaagacgttccgtaagtcgtaagtcggtgacctaactaccgaagttacttacggaacggtaaggggtcccggttacccagtaccggtaggttacaacggttggaccgtaggtcacgtacgtttacggaacgggaactaacgtaactttaaccgccttaccttacgtaaactacgtacgaacgtccacgtacccgtagacctacgtactaaggtaacgtttatttacgtaactttaaatttacgtctaaggttacaacgttagttaactagtacccgtacgtagtcgtacgtcggcgaaggtcgaaggtagtaccgaacgtaaccggtangtccgngtnacc

SEQ ID NO: 215198 - DNA, 917 bp, Homo sapiens
  misc_feature: GYAE6OF01CAEZF.1.34.D01.1.454.CMB.1.raw
  modified_base (101)..(101): a, c, t, g, unknown or other
  misc_feature (101)..(101): n is a, c, g, or t
  modified_base (110)..(110): a, c, t, g, unknown or other
  misc_feature (110)..(110): n is a, c, g, or t
  modified_base (118)..(118): a, c, t, g, unknown or other
  misc_feature (118)..(118): n is a, c, g, or t
  modified_base (121)..(121): a, c, t, g, unknown or other
  misc_feature (121)..(121): n is a, c, g, or t
  modified_base (143)..(143): a, c, t, g, unknown or other
  misc_feature (143)..(143): n is a, c, g, or t
tcagacgagtgcgtcacgaccggtgctcgatttagatcgtctgtgttgggtttgggggagtcagaccctgtcaggacacagcatggacatgagggtccccntcagctccngggctccngcncgctgtcgcctaccgtacgacncgtcgtgacactactactacgtacccgaccgtactccctacctccttcccttccgtgtcgtcgacttactacgttagggtaaggaacacgtaacggtacctaccgaacctctaaccgttcgggtcccgggccgggaacgtaccggtacgaccggtaacctcgacggtacggtacttactttaccggttcgtccggttgtacgacgtacgaccgaaacgacgggaccggacccgccctacccgtagtacgttcgttaaccggttacgttagtttacgggtcgaccgtaacgttccgtaaacgtaggttacgtaccggtacggggtaaccggggttccccgtaccgttacccgttacggttaacgggtcgtacgggtacgtacggttagtaccgtaacgtttcggggttacggaaacgttaaccggaatttaacccttacccgttaccgtaccttaaccgttacttaaccgaaccggtacgttacccgacggtcccgtccggaaaccggtccgttaaaccgtaacggtttaagtttaccgtttaaacgtttacgttttaaaccgttttacggtttaacggttaacgtaaacccgtaacgtttttagttaaacccgttttaccgttaacccccgggtttaacggtttaaccggggttccggtttaaccgggttaccgggaaacccggggttaacccgggtaaagggttaccgggtaaacccgttaaccggaaaccggttacgttacggttaccgggtctacggtaacccgtaacccg

SEQ ID NO: 215199 - DNA, 816 bp, Homo sapiens
  misc_feature: GYAE6OF01BQUYE.1.34.D01.1.454.CMB.1.raw
  modified_base (211)..(211): a, c, t, g, unknown or other
  misc_feature (211)..(211): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatccctccctgtctgcatctatggagacagactcacntctacgttcggccgggacgtacgtcgacggccagtcacgcgtattttccgtttacggtccgttgggttcgacacggaccgaaacggaaaaccgacgggggccgacccgccccctacgagtaacgttaccgtagtttcgtaggttcggtcgccaactaccgaagttacgttcgacggtaacggggttccgggtacccctagtacccggtacggttacgaggtcggacgtaggtcgactagtccggtacggaacgttacgtaaccttaccgtaaccctttgtaacctaaccgttaactaccgtaacgaccgtaacgtccctacgggacctaccggtccctttaaggttaaacgttttactttttaccgaaacgttttaactttttaaccgttaaccgttacggtttaaaccctaaagtttaacgtttaaccgtttaaccggtaaccccggtttaaaccccgttaccgggtttaccggtaaccccgggtttaaccgggaccggggttaaaccgggggtaaccggttaacggggttaccgggaaaacccggtttaaccgtaacggggttaacccgtttaggtcccgggttacccgtcggttaaaccccg

SEQ ID NO: 215200 - DNA, 627 bp, Homo sapiens
  misc_feature: GYAE6OF01BO2XO.1.34.D01.1.454.CMB.1.raw
  modified_base (102)..(102): a, c, t, g, unknown or other
  misc_feature (102)..(102): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtccaccagtcacttggccggcgagtcaggccatcgagcgtattctttagccttggtgcagcagaaccngggcacgcccctnagatcgtagtctagtggtncgatccagtattgacgtaaggtcgggtacccagtccgaggttcaggtcgacgagtcgactagtccggtagggacaggtaacttacgtacctctacacttagcgaacgcgtaacgccgttgaccgtacgtccttaggaaagttttcttttaacggaacttttaagttttacttaaccggttacgttaacgtaaagtttaacggttattaacccgttaacccgttaacccgttacggggttaccgtaccgggttaccgggacggtaacggggaaccggtaagggtacggtaacgtacccgaaacgtacttggtacgtcgtgacccg

SEQ ID NO: 215201 - DNA, 664 bp, Homo sapiens
  misc_feature: GYAE6OF01CPQ0M.1.34.D01.1.454.CMB.1.raw
  modified_base (105)..(105): a, c, t, g, unknown or other
  misc_feature (105)..(105): n is a, c, g, or t
  modified_base (152)..(152): a, c, t, g, unknown or other
  misc_feature (152)..(152): n is a, c, g, or t
  modified_base (191)..(191): a, c, t, g, unknown or other
  misc_feature (191)..(191): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
  modified_base (655)..(655): a, c, t, g, unknown or other
  misc_feature (655)..(655): n is a, c, g, or t
tcagacgagtgcgtcacgaccggtgctcgatttagatcgtctgtggttggggttgggggagtcagaccctgtcaggacacagcatggacagtggacgggtccccntcagcctccgtgggcctcctgctgctcgtcggcctcccgaggtaccngtctgtacgactataccaagtccgaccctagtcctaccncgttccctccgtgtctcgctacttacgtaggtaggaacgacgacgtaacgtaccaacttatccgtaacgttccgggaccgggactacgtacgacggacctagtaccgaggtacttacgttttaccgttacggccgttaggtcgaactacggaacgaaacggaaaccggcgggtaccacccgtcctaagagtctaccggtatacgttagtcggtcaacgtactacgagtagtcggaggtaacgggtcgtacctagtccggatgaggtcagntgntagcgagactgtaacttcnctctaacattcgcgaactacgctacgaggtcacgtctaattaaggtctttaacgattttaaactgtaactacgagtaacgttgtaacttcggaacccgttaacgtggtaccgttaacggccgaaaggtacgaacgtaggaaacgtaccacgttaaaccggagtggtaacctnacggtaacc

SEQ ID NO: 215202 - DNA, 829 bp, Homo sapiens
  misc_feature: GYAE6OF01C6T7I.1.34.D01.1.454.CMB.1.raw
  modified_base (816)..(816): a, c, t, g, unknown or other
  misc_feature (816)..(816): n is a, c, g, or t
tcagacgagtgcgtcacgaccggtgctcgatttagatcgtctgtgttgggtttgggggagtcagaccctgtcaggacacagcatggacatgacgggtccccgctcagctccgtgggctcctgctgctctggctcccaggtaccagctgtgactataccaattcgacccagtcctccactccctccctgtctgcctatcttagttggacgaacgagtacgtaccaaccctattccgtaacggtttccgggacccgggggacgtacgttccggaacggcctaagttccgaagtaccgttactttacgttttacggccgtttggttacgacgtacggaccgtaaacggaaaaccggacggggccgtaccgtccccgtagaacggtacgtttaccggttagttacgttaaggtttcggtactacgtacgtacgtaaggttacgttcggaacgggttacggggttccggtaaccctaggtacccgttaggttacgggacggttcgggaccgtagggtacgacgttaacggtacgggtaacgggaacttacgtaacctttaaaccgccttactacgtaaaccttactaccggactaccgtacgtcctacgacccgaaacgtttccggtaaggtttaactttacggtttcgtaaacttttaacgttttactacggttacgaaacctttaacgttacttttaaaccgtttacggtaccccggttaaccgttcggggtaaccggtcccgggttacccggaagggtaacccgggttacggtaaacggttcgggaaaaccgtaaccgtaccgggtaactgggtaccncgttcaaacccgg

SEQ ID NO: 215203 - DNA, 734 bp, Homo sapiens
  misc_feature: GYAE6OF01BOWSV.1.34.D01.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (540)..(540): a, c, t, g, unknown or other
  misc_feature (540)..(540): n is a, c, g, or t
  modified_base (573)..(573): a, c, t, g, unknown or other
  misc_feature (573)..(573): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtctccatccctccctgtctncatctatgganacngagtcaccatcacttggccggcgagtcaggccatcagcgtattctttacgccgttgggttcgccagaccaaacggaaaacccggaggggaccgacgccccccttagaacgtacgttaccggttagttacctaaggttcgggttacggaccttaacgtacccgtaaaggttacgtttacgggaaccggtaaagggggtttcccgggggttacccctaacgttaccccggtaagggtttaccgtaagggtccggtaccgtaggttcggactacgttccggtagggaactaagttacttaacctacgtcctacaacttacgtccaagtccacgtcccgtanaccggtacgtacgttagtaagttacgtttttanaaccgttttaatttaacgttacctagttaacctaaagttacgttatttaaccgtaaccggttaccccgttagggttaccgggtacccggttccgggacgtaacggggaccgtaagggtacgtaacgtaccgaaaccgtacgtaggtacggtcgtcgtaccg

SEQ ID NO: 215204 - DNA, 866 bp, Homo sapiens
  misc_feature: GYAE6OF01CWGVY.1.34.D01.1.454.CMB.1.raw
  modified_base (331)..(331): a, c, t, g, unknown or other
  misc_feature (331)..(331): n is a, c, g, or t
tcagacgagtgcgtcacgaccggtgctcgatttagatcgtctgtgttgggtttgggggagtcagaccctgtcaggacacagcatggacatgacgggtccccgctcagctccgtgggcctcctgctgctctggcctcccgaggtaccagctgtgacatccaattcgacccagttcctccactccctcccgtagtctgactattctagttggacgacaggactacaaccatcctacgttcggccggacgacgtcgacggccagtcgaacgtacgttaacgtttcgtttaacggtccgttcgggttgacaacggaaccgaaacggaaaaccggngggaccgtacccgtaccccgacgaacggtcgtaccggtaagtaccgtttaggaggttacgactaacgtacccgaaggttacgttaggaccggtaaacgggggttccggtaccgtaacgtttaaccggtacggtttaccggaagtccgggacgtagtcgtactacggtacggtacggtaacgtaagtaacctttaaccgacttacctaaccggtaatacgtacacggtacaccgtcgtacgtacgaccgttaacgacgtttaaacgttcgtttaactaaacgtttttaacgtttaaaccttttcgaaacggttaactaaaacgtttagtttaaaaccgtttaccggttaaccccgttaaacccggggttaacggggtttaccccggttaaccggggttaaaccccgggggtaaacggggtaacccgggggttaaaaccgggttaacggggttaaacgggttaaaaccccccgggaaaggttaaaacccccgtacgggttaagggttacccggggtaaacttcccggtaaaaccccg

SEQ ID NO: 215205 - DNA, 743 bp, Homo sapiens
  misc_feature: GYAE6OF01B2RBZ.1.34.D01.1.454.CMB.1.raw
  modified_base (102)..(102): a, c, t, g, unknown or other
  misc_feature (102)..(102): n is a, c, g, or t
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggggagtcagaccctgtcaggacacagcatggacatgacgggtccccnctcagctccgtgggcctcctgctgctcgtcggcctcccgaggtaccagctgtcgactactacctaattccgaccctagtcctacccacttccctcccgttgtctacgctacttctagttaggacgacagtacgtccaacctattccgtaccgttcgggaccgggacgtacggtaccgacggaccacgtacgacggtaccgttactttaccgtttaacgggtccgttgggtacgacgtaacgaaccgaaacggaaccggacgggacccgacccgtacccctagaacggttcgttacggtaacgttcgtagtgacgctactcgagtatacggcggtacggggccgtactacgtacgtacgtgacgtggtacgngtacgacgtacgtacggtacggaactagtaaccgtcctaccgtactacacttacgcgacgcgacgtccacgtcacgtaacgtaggtttaacttacgtttagtaactttagtttaccgttaacgtattaaaccgtatttaaccggttataacccggttaccggttaaccccggttgtacccggttacggaccgggtaacggtaacccggggtataaaccggggtaactaaaccggaccgtaaccgggttattgggaaccgtcgtactaccg

SEQ ID NO: 215206 - DNA, 773 bp, Homo sapiens
  misc_feature: GYAE6OF01CRATM.1.34.D01.1.454.CMB.1.raw
  modified_base (233)..(233): a, c, t, g, unknown or other
  misc_feature (233)..(233): n is a, c, g, or t
  modified_base (763)..(763): a, c, t, g, unknown or other
  misc_feature (763)..(763): n is a, c, g, or t
tcagacgagtgcgtcacgaccggtgctcgatttagatcgtctgtgtttgggtttgggggagtcagaccctgtcaggacacagcatggacatgacgggtccccgctcagctccgtgggctcctgctgctctggcctcccaggtaccagctgtcgacatccaattcgacccagtcctccactcctccctgtctgctatctattggagacagagtcaccatctacgttcggccggngagtcacggccatcgagtcgtatttcgttacgcgttggttgacacgacaacggaaaaccggcggggaccgaacccgccccgtacgaagtacgttacgttaacgtcttaaggtgggtctactacgtaccgagtacgtcggacggtaacggggtcggtacccacggttccgtaacggttacgcggtcggacgtacgtcgtacgtacggttcgtacgggtaacgtaagtttaaaccttacccgtacgtcccgttaactaacttctaccggaacgacgaccgtccctaacggcgtaccggtaccgttaagtaaccgtttagttttaccgaagtttttaactttaacgttacgttaacgttaccaaaagtttacccgttttaattacccggtttaaacccggttaaccccgttagggtaacccgggtttccggttacccggggaaaccgggttacggggtaaaaccgtacgggggtaccgttaaaaccggttacccgtaaaaccccggttattccggggtaaccggtcccgttanaacccccggg

SEQ ID NO: 215207 - DNA, 705 bp, Homo sapiens
  misc_feature: GYAE6OF01AJHXM.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctattgtagacagagtcaccatcacgttcggccggggcgagtcaggccatcagcgtattcgtttagccgttggttgcagaccgaagaaaccgngggccgacgccccctcgaagtatcgtagtcttagtcggtgacctatcccgagtacgttcggacggtaaggggttccggggtccccaagttccccgtaagggtttccgaagggttcgggcgtaacggtcgtaccgtaggttccggtagggaacctaggtaaccttaccaccttcctaccgtaacttacgtaccgtacggccgtacggtcccgtgacccgtaacgtaccgttaggtaaagtttcttttacgaactttaacgttttacttacgtacgttactaaacttaggtttaactttaccgtaaccgttaccccggttaggttcgggtaccggttacccgggaccgggtacggggtaacccgtaaggggtaccggtaaacgttaccgtaaacccggtacgttagggtccgcgttcgtaacccg

SEQ ID NO: 215208 - DNA, 685 bp, Homo sapiens
  misc_feature: GYAE6OF01AZ01W.1.34.D01.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (491)..(491): a, c, t, g, unknown or other
  misc_feature (491)..(491): n is a, c, g, or t
tcagacgagtgcgtcacgaccggtgctcgatttagatcgtctgtgttgggtttgggcatggacatgaggtccccgctcagctcctggggctcctgctgctctggttcccaggttccagatgcgacatccagatgacccagtctccatcttccgtgtctgcatctggtcgagacagagtcaccatcacttggccgggcgagtcagccatccagcgtatttcttagcctggttnctagcagaaccaggcgacnccctnagntcgtatctagtggtnacgactccgagtactcggacgtaaggggtcgggtaccctagttcccgtacggggtttaccaggtagggtcctaaggttcgaccgtaggtccggtacgggaactacggtactttaccgacttactactaaacgttcgcaacggtcacggtcctacggacacgtaccgttagtaaacgtttatttacggacctttaattttacttaacgtacgtttaanaaccgttaatttaacttaacgtaaccgtcccttaagggttccggaacggtttccgggaaccggtaacggggtaacctaagggtacggtaaacgttacccggaaaccggtaacgttcggttacgaccgttaccacccgtaacgttacccttcgttcggttacttaccttccgttacccccttcccgttaaccccg

SEQ ID NO: 215209 - DNA, 793 bp, Homo sapiens
  misc_feature: GYAE6OF01C02MW.1.34.D01.1.454.CMB.1.raw
  modified_base (345)..(345): a, c, t, g, unknown or other
  misc_feature (345)..(345): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctcgtggcctcccgaggtaccagctgtgactatccaattcgaccctagtcctccactccctcctgtctgctatctagtggacactagactaccacctattccacgttggacccggggacgaacgtcgaaggccctaagtcgaagtccgttacgttttaccgtttacggtccgttggttcgaccgagaccgaacgaaccggacggcgacgtaccccgtanagtactcgtagttctagtggtacgactacgtacgtagtacggttcggaacggtaaccggggtcgggttacccccacgttttacccggaggttaccggtaacgggtcggtacgtacggtccgaacgtacggtcgggttaacggacttaacgacttaacctccttactactaacgtacgtacacgacgacgtccgtacgaccgtcgtaaccgttagttaaccgttagtttaccgtaaacgtttaacttttaacgttaaccgtttaaggtaaccctttaaagttaaacttttaccggttaccgttaaccccggttaacccggttacgggtaccgggttaaaccccggtcggggttaaaccggggaaccgggttaaccggttaaacggggtaccgttaaacggtaacccggtaaacggttcgttaccgggtacgtcccgtaccgttaacccg

SEQ ID NO: 215210 - DNA, 753 bp, Homo sapiens
  misc_feature: GYAE6OF01B8RYV.1.34.D01.1.454.CMB.1.raw
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccactcctccctgtctgcatctagttgganacagagtccaccatcgacgttggccggggcgagtccaggcccagtcgagtcgtatttcgtttacgccgttggtgcagacaacggaaaccgngggccgaccgcccctgagtactcggtagtctaggtggtcgacgtataccgagtacgttcggacgtaacgggggttccgggtacccctagtacccggtaggtttacgacgggttcggtacggtaaggtcggacgttacgttccggtaaggggtaactaagggttaccttaacctaccgttacctaacctactaacgtcgaacgttaccgacgtcccgttgccgtaaccgtcggttaacgttacgtttaacgttttacgaaccttttaaagttttacctttaacggtccttaaaccgtaacgttaacgttttaacgttaaccggttaacccgtaccccggtttaaggggtccgggttaacccgggttaccggaacccggggtaaacgggggtaaccggtaaaggggtacggtaaacccgttcggaaaaccgtttacgtcgggtaaccggtcgtccgtaacccg

SEQ ID NO: 215211 - DNA, 796 bp, Homo sapiens
  misc_feature: GYAE6OF01BZHBX.1.34.D01.1.454.CMB.1.raw
  modified_base (211)..(211): a, c, t, g, unknown or other
  misc_feature (211)..(211): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (512)..(512): a, c, t, g, unknown or other
  misc_feature (512)..(512): n is a, c, g, or t
tcagacgagtgcgtcacgaccggtgctcgatttagatcgtctgtgttgggtttgggggagtcagaccctgtcaggacacagcatggacatggacgggtcccccgctcagctccgtggggctcctgctgctcgtggcctcccaggtaccagctgtgacataccaattcgacccagtcctccctactccctccctgtctgctatctagtgganacagactaccacctatcgtacgttcgggccgggacgtacgtacgacggcctatcgaacggtcgttaatttccgtttacggccgttgggttcacgagaccgaaaggaacccgaggggaccgtaccgcccctagatacgtccgttntacgtagtcggnctagtcagtacgttggacgtaacggggtccggtacctaaggtccgtacggttacngggttcggacgtacggtcgtacgtaaggttccggaaagggcttaaggttacctaccgtctacctacacttacgacgacgtccgcgtaccncggacacccggttagtaggtttaaagtttacttttaacggtaactttttaaacgtttaacgtttacccgtaagtttaaaccctaaggttttaaggtttaacccttaacccggttaacccgggttaaccccgtttacgggtacccgggttaccggggttaacccgggaaacgggggttaaaggggaaccccggttaaaggggtttaaccgggtaaaaccctaccccggggttaaaaaccgggtttcggtaacgggttcccggggtaaacccttacggtaaacccc

SEQ ID NO: 215212 - DNA, 601 bp, Homo sapiens
  misc_feature: GYAE6OF01BD746.1.34.D01.1.454.CMB.1.raw
  modified_base (174)..(174): a, c, t, g, unknown or other
  misc_feature (174)..(174): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtcctccatccctccctgtctgcatctattgganacagagtcaccatcacttggccgggcgagtcaggccatcagcgtatttcgttagccgttggttcncagcagaaaccgnggggcacgcccctanagtagtcgtagtctatggtncanccagtnttgacgtaagggtcgggtaccataccgtaggtcaggtgacagtgacgtacgtcgtagggaacgtagtacttaccacttctacactactcacgcacgtcncgnacgtacgtagaacttgttacgacttaactttacgtacgtagtacgaacttagttacttaagtaccgttaacccgtagtacggtcccggttaccggacggtacgggaacgtaacgggtacgtaacgtaccgtaacggtacgtcggtcgtccgacgcccgtacctagttccgttcgtaccttacaccgttacccgtcccgtaccg

SEQ ID NO: 215213 - DNA, 613 bp, Homo sapiens
  misc_feature: GYAE6OF01DEIJM.1.34.D01.1.454.CMB.1.raw
  modified_base (133)..(133): a, c, t, g, unknown or other
  misc_feature (133)..(133): n is a, c, g, or t
  modified_base (234)..(234): a, c, t, g, unknown or other
  misc_feature (234)..(234): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (580)..(591): a, c, t, g, unknown or other
  misc_feature (580)..(591): n is a, c, g, or t
  modified_base (593)..(613): a, c, t, g, unknown or other
  misc_feature (593)..(613): n is a, c, g, or t
tcagacgagtgcgtcacgaccggtgctcgatttagatcgtctgtgttggggtttgggagtcaggccatcagcgattctttagcctggttgcagcagaaaccagggcgagcccctcagatcgtagtctatggtncactccaagtagttggacggtaagggttcggggtacccccagttcccgagggttccaggtcggcagtgctagtcgtaggacagtaatacactcacacgtancgagcacgtcctgcacgcctagtaagttgtttgattaatttactacgtactacgtaacttagttaacttaaccgtaccgttaccccgtaggtacggtaccggttaccggaccgggtaaggggaaccgtaaggggtaacggaacgttacccgaaaccggtacgttgggtacggccttacggacctaaacttcgttcgttacgtttcttaaccgttcccgtttaccccgtccccgtactaacggtttcccaacgggtaacctcccgttacgttccgggtacgtcgggggaaccggtccgggttacgccgggaacggaccggtaccggtactgggtacgnacgtnagtnnnnnnnnnnnnannnnnnnnnnnnnnnnnnnnn

SEQ ID NO: 215214 - DNA, 927 bp, Homo sapiens
  misc_feature: GYAE6OF01CD3NH.1.34.D01.1.454.CMB.1.raw
  modified_base (205)..(205): a, c, t, g, unknown or other
  misc_feature (205)..(205): n is a, c, g, or t
tcagacgagtgcgtcacgaccggtgctcgatttagatcgtctgtgttggggtttgggggagtcagaccctgtcaggacacagcatggacatgagggtccccgctcagctccgtggggctcctgctgctctggctcccaggtaccagctgtgacatccaattcgacccagtcctccactccctccctgtctgctatctagttgganacagacgtcaccatctactggccgggcgagtcacggcatcgagcgtacttcttttacgccgttggttcgacagaccgaacggaaaacccgacggggtaccgacgtcccccctcgaacggtacgttcggtaagtccgttagttcgggtcgcctaacgtcccgaagtacgtttacggacggtaaacgggggttccggggtaccccctaggtcccggtaacgggtttcggtaacgggttcggggaacgtacgggttcggtaacccgttaacggtttaccgggttaacgggggtaaacgtaacgggttaaacttttaacccgtaaccgtttaccccttaccttaaccgttaaccgttaaccgacggtacccgtaacggtccccgttaccgaccggttaaccggtacccgtttaagggtaaaaccgttttaaggtttttaccgttaaaccgtttttaaaagttttttaacgtttaacccgtttacgtttaaacccgttaaaactttaaacgggttttaactttaaaccggtttaacccccggtttaaccccggtttaaccggggttaccggggttaaccccggggtttacccggggaacccgggggtaaccggggttaaaccccggggtaaaacggggttacggggtaaaaacccgtttaacccggggtaaaacccgttaaccgggttttggggtaccgggttaacccggttaccggttaacccccg

SEQ ID NO: 215215 - DNA, 745 bp, Homo sapiens
  misc_feature: GYAE6OF01DBZN0.1.34.D01.1.454.CMB.1.raw
  modified_base (200)..(200): a, c, t, g, unknown or other
  misc_feature (200)..(200): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactcctccctgtctgcatctattagganacagatccacatcacttcggccgggcgagtcacggccatcagcgtattctttagccgttggttgacagcaacgaaaccgagggccgacgcccctagaagtatcggtagtctagtcggcgactatccgagtacttggacgtaacgggtcgggtaccccagtaccggtagttccgaggtcggctaggtcgacgtacgtcggttaggaacctagttaacttaaccgaccgtccttaacaacgtacttacgaacggtccaaccggtccctggtaccgaacgttacccgttaaggttaaacgtttacgttttaggtaaaccttttaaatttttaaccggttacttaaggtttaacccgtaaagttaacgttttaaccctttaaggtttaaccccgtaaaccccgtttaacggggccgggtttaacccggggttaccccgggtaacccggtaaacgggggttaacccggtaaagggggttaaccgggtaaaacttaacccgggaaacccccggtttaagcgggggtttaccgaccggttccgtaaacccgg

SEQ ID NO: 215216 - DNA, 729 bp, Homo sapiens
  misc_feature: GYAE6OF01B7N53.1.34.D01.1.454.CMB.1.raw
  modified_base (211)..(211): a, c, t, g, unknown or other
  misc_feature (211)..(211): n is a, c, g, or t
  modified_base (614)..(614): a, c, t, g, unknown or other
  misc_feature (614)..(614): n is a, c, g, or t
tcagacgagtgcgtcacgaccggtgctcgatttagatcgtctgtgttggggtttgggggagtcagaccctgtcaggacacagcatggacatggacgggtccccgctcagctccgtgggctcctgctgctcgtggctcccaggtaccagctgtgacatacaattcgacccagtcctcactccctccctgtcctgacattcgtaagttggaanacgagacgtacaaccgtatctaacgttcggaccggggcgtaagtcgaaggacctagtacgacgacgtatttactttaacgtccgttaggttacgacgaacgtacgaaacgtaaaaccggacggggaccgaccggtacccccgtagaacggtacttaccggttaacgtacgttaacgtgggtaccaactaagtaccgaagtaacgttacggaccgtaacggggtccgggtacctacgtaccgtaggttacgaggtacgcgtaacgtcgacgtaccgtggtacggtaacctaaggtaattaccctaacttacgaacttaacttacacgtacgacgtacgaccgtacggacctagacgtaagtaacgttagttaccgtattaatttaagtacctacgtataaactnttaacgtactaaccggttacccgtaggtaccgtacgggttaccgaaccgggtaacggaaccgtaacgggacgtaaacgtaaccgtaacggtactacgggttacagtcccggtaac

SEQ ID NO: 215217 - DNA, 719 bp, Homo sapiens
  misc_feature: GYAE6OF01DVP6Q.1.34.D01.1.454.CMB.1.raw
  modified_base (105)..(105): a, c, t, g, unknown or other
  misc_feature (105)..(105): n is a, c, g, or t
  modified_base (219)..(219): a, c, t, g, unknown or other
  misc_feature (219)..(219): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagacgagtgcgtcacgaccggtgctcgatttagatcgtctgtgttggggtttgggggagtcagaccctgtcaggacacagcatggacatggacgggtccccgntcagctccgtgggctcctgctgctcgtggcctcccgaggtaccagctgtagactataccaagttcgaccctagtcctaccacttccctccctgtctgactattactagtagganacagtacgtccacctatccgtacgttcggccgggacgagtacgacggccatcgagtcgtactttacgttacgcgttggtcncgaaggacaacggaacgngggccgacctccctagagtacgtcgtagtctagtggacnctactcgagtacgtacgacggacgggtcggtacctacgtcgtaggttcggaggtgtacgtagtcgtacgtacggtcggtacggaactagttacttaactacttccgaactacttacgacncggtaccncgtaccgtagtaccgacgttacgtaggttaagtttacgttactaacgtttactttaacgtacgttacgtaaacccttaagttaacgtttaacttaacccggttaacctaccccgggtttaagggttacccgggtaacggtttaccgggaaacccgggttagggtaaaacggttcgggtaaacggtaaccgtacggttaaaccgtaggtaccggttacgaccggttctaacccgg

SEQ ID NO: 215218 - DNA, 828 bp, Homo sapiens
  misc_feature: GYAE6OF01EN5UN.1.34.D01.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
tcagacgagtgcgtcacgaccggtgctcgatttagatcgtctgtgttgggtttggggggagtcagaccctgtcaggacacagcatggacatggacgggtcccccgctcagctccgtggggctcctgctgctctggctccaggtaccngctgtnacataccaattgacccagtctccatccctcctgtctgcatctagtggacacagactcacctatctacgttcggccgggcgagtcgacggcctatcgagcgtatttccgtttacgccgttgggttcgacacgacgaacggaaaccggaggggccgaccgccccctagagtacgttcgtacgtcgtagtgggtcactacgtcaaggtattcggacgtaacgggggttccgggtacctacgtcccggtaaggttcgtaaggtcgggtaccgtaggtccggacccgtacggtacgggaaccgtagttaaccttaaccgaccttaccgtacctaactacgtaccgacgtaccgtaccgtaccgtacgaccgtacggtacccgttaaggtaaccgtttacgttttaacgaacttttaaacgttttaacgtttaaccgttacgttaaacccgttaaacggttaaacgtttttaaaccgttaaccggttaaaccccggtttacccggttaaacccggggtttaccggggttaacccgggttaacccgggggtaacccgggtaaaccggggggtaaacccgggttaaacgggggttaacccgggtaaaaccggttaaaccccggtaaacccggttacgggttaacgggtaccgggttaccgtaaccggtacccgttaaacccgg

SEQ ID NO: 215219 - DNA, 622 bp, Homo sapiens
  misc_feature: GYAE6OF01A7OWH.1.34.D01.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattgacccagtctccatccctccctgtctgcatctattgganacagagtcaccatcacttgccgggcgagtcaggccatcagcgtattctttagccgtggttgcagcaagaaaccgngggcacgcccctnagatcgtagtctagtggtgctactccaagtattggacgtaagggtcgggtacccagtcccgtaggttcaaggttcggcgtagtcgctagttccgtagggaactagtacttaccgtacctcgtactactatccagccagcctgacgacgtccgtagtaagttactttacgacttaaattttacttacgttagtaacctaaacgttagttaacttacgtaacccgttaaccccgttagggtaccgttaacccgggttccggtaccggtaaggggtaccgtaaagggttacggaaaccgttaccgaaacccggtacgttacggtcgtccgtgtaacccg

SEQ ID NO: 215220 - DNA, 771 bp, Homo sapiens
  misc_feature: GYAE6OF01BMK6K.1.34.D01.1.454.CMB.1.raw
  modified_base (595)..(595): a, c, t, g, unknown or other
  misc_feature (595)..(595): n is a, c, g, or t
  modified_base (600)..(600): a, c, t, g, unknown or other
  misc_feature (600)..(600): n is a, c, g, or t
tcagacgagtgcgtcacgaccggtgctcgatttagatcgtctgtgttggggtttgggggagtcagaccctgtcaggacacagcatggacatgacgggtccccgctcagctccgtggggctcctgctgctcgtggcctcccaggtaccagctgtgacataccaattcgaccagtcctccactccctccctgtcctgctatctagtggacgacagacgtaccacctactactacgttcggcccgggacgtacgtccgaacggcctacgtacacggtcgtttaacttttccggtttacggtcccgtttgggttacgaccgtaaacggaccggaaaacggaaacccgggcggggtaccccgtacccggtaccccctaggtaacggtaccgttaccgggttaagttaccgttaggttcgggtaccaccgtaacgtacccgtaagttacggtacgggaaccgggttaacgggggtccccgggtaacccctacggtacccggtaaggggttcgacgggtacggtacgtacgggtcgtaacgtaggttaccgggacgggtaactaacggttacttaaccgttcctaacgtacctacgttaacncgacncgtaccgtctacggccgtacgtaacggtaagttacgtttacttacgtaactttatttactacgagttaacctaagttacttaatacccgtacgttaccgtggtaccgtaccggacggacgaagggtacgtacgggacgtaccgacgaccggtagtacgcgtcgtcgtaccg

SEQ ID NO: 215221 - DNA, 814 bp, Homo sapiens
  misc_feature: GYAE6OF01BB97K.1.34.D01.1.454.CMB.1.raw
  modified_base (213)..(213): a, c, t, g, unknown or other
  misc_feature (213)..(213): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggagtcagaccctgtcaggacacagcatgggacatggagggtcccccgctcagctcctggggcctcctgctgctctggcctacccgaggtacccagctgtgacatacccaattcgacccagtcctccactccctcccgtgtctgcattctattgganacagatcaccatcacgttcggccgggcgtagtccgaggccagtcagacgtactttctttacgccgttggttcgcagacaaggaaaacccgnggggacaccggtccccctacagtacgttccggtagttactagtcggtagccagtccagtattggaccggtaacggggtccggtacccctacggttccgtaacgggttccgaagggtcggtacgtacgggttacgtacctacggttacgggtaacggggaactaacgggttaacctttaaccccgtacttacccgtttacctaacgttaacgtacccggtaaccgaacgtaccggacccgttcggaaccaccggttacccgtaggttaacgttttaacgttttacggtaaccttttaaaggttttactttaacccggttaacttaaaccgtaaacgttaagttttaaccgtttaaccggttaaccccggttttaccccggtaacggtttacccgggttaccgggtttaccccggggaccggggttaaccggggaaccggtaaaggggtaacccggttaaacgtaacccggtaaaccggttacgtacgggtccggtacgtaccgtaaccccg

SEQ ID NO: 215222 - DNA, 586 bp, Homo sapiens
  misc_feature: GYAE6OF01AHLRH.1.34.D01.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (547)..(549): a, c, t, g, unknown or other
  misc_feature (547)..(549): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (561)..(562): a, c, t, g, unknown or other
  misc_feature (561)..(562): n is a, c, g, or t
  modified_base (564)..(566): a, c, t, g, unknown or other
  misc_feature (564)..(566): n is a, c, g, or t
  modified_base (568)..(579): a, c, t, g, unknown or other
  misc_feature (568)..(579): n is a, c, g, or t
  modified_base (581)..(586): a, c, t, g, unknown or other
  misc_feature (581)..(586): n is a, c, g, or t
tcagacgagtgcgtcacgaccggtgctcgatttagatcgtctgtgttgggtttgggagtcaggccatcagcgattctttagcctggttgcagcagaaaccagggcgacgcccctcagatcgtagtctatggtgcatccagattgacaagggtgggtcccatccaggttcagtggcagtgcatcgtgggacagtattacactctcactancagcagctgcagcgtagaacgtnttttcgacttaattttacttacgtagtaccaaactagtttaacttacgtaaccgttacccccgtaggtacgggtaccggttccggaccggtaacggggggaccaaaggggttcggaacgtacccgaaaccggtacgttgggtcggtacctcggacctaaccgtagttccgttagttcctttacgtaacctttcccggttaccccaccttaggttaaccgtggaaacccgtccttaaccgtccggttcgaggtaccgggcgggtactcgggaaccgtaacggcgtaactagttaccgntcncagtganacgcnacnnncngcnctgngtnngnnncnnnnnnnnnnnncnnnnnn

SEQ ID NO: 215223 - DNA, 784 bp, Homo sapiens
  misc_feature: GYAE6OF01AEDLI.1.34.D01.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctatgganacagngtaccacatcacttggccgggcgagtcgacggccatcagtcgtattctttagcctgggttgccgtagacgaacgaaaacccgtaggggaccgaccgcccccgtacgacgtacgttaccggttacgttccttagtcgggtacgctactaccgtaaggtactttcggaccggtaacggggtcgggtacccctaacgtcccggtagggtttccaagggttcggacctaggtacgtacgtagttaccggtacggggaactaaggtaaccgtttacaccttcgttaccgaaaccgttcgtaccgtaacgggacctaaccgggtcccttacgggaacccgtaccgggtaccccgttaagggttaaacgttaacttttttaccgggaactttttaaccgttttaactaaccggtttacgtaacccttaaacgtacgtttaactttaccggttaaaccccgtttacccgtacggttaccgggttaaccggttacccgggaacccgggttaaaccggggaacgttaacgggtaccgggtaaaccgttacccggaaaccgttacgacggttacggaccgttaccggtaacccg

SEQ ID NO: 215224 - DNA, 741 bp, Homo sapiens
  misc_feature: GYAE6OF01B4118.1.34.D01.1.454.CMB.1.raw
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgacgggtccccgctcagctccgtgggctcctgctgctcgtcggcctcccgaggtaccagctgtcgactactaccaattcgaccctagtcctaccacttccctcccgtgtctgctatctagttggacgacgagtacgtaccacctacttacctaccgttcgggcccggggacgtacggtaccgacggcctatcgacgtacgttatttccgtttacgtccgttggttcgacgaacgaccaaacggaaccggacggggaccgaccgtaccccgtagaacgtactaccggttagtccgtagtcgggtacnctactacgtagtagtaggaccggtagggtccggtacctcgtacgtacggtcgtaggtcgtacgtagtcacgtagtcgtaggaactagttactactaccgttctaactaacgtctacgacgtacctacgtcgacggacacggtacgtaaggttatttacgttttaacgactttaagtttaccttacgtacgtactaaacgtttagttaactttaacccggtaccgttacccgttacgggtaccggttaacccgggtacggtaacccgggttaggggaaacccggtagggttaacccgggaaaccgttacccgaaacggttaggtacggcgttacgtaccgtaaccg

SEQ ID NO: 215225 - DNA, 611 bp, Homo sapiens
  misc_feature: GYAE6OF01BWLGT.1.34.D01.1.454.CMB.1.raw
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattgacccagtctccatcctcctgtctgcatctatggagacagagtccaccatccacgttggccgggcgagtcgaggccagtcagcgtattcttagccttggtgcagcaaggaaccngggcgacgcccctnacgatcgtagtctagtggtcgacaactccgaaggtacttcggacggtaacgggtcgggttacccagttccgaaggttcaggtggcgagtcgctacgtcgtaggacagtaactacgtctcgtacacgttatacgtacgacgtacgcctacggactaccgtcgtaagtaaacggttacttttacggacctttaagttttaacttacgtacgtaactactaagttacgtttactaccggttaacccgtagtacggtacgttaccggaccggtacgggacgttaaggcggtaaagtacccgtaacgaacgttggacggtcgtcgtac

SEQ ID NO: 215226 - DNA, 643 bp, Homo sapiens
  misc_feature: GYAE6OF01BGA9W.1.34.D01.1.454.CMB.1.raw
  modified_base (103)..(103): a, c, t, g, unknown or other
  misc_feature (103)..(103): n is a, c, g, or t
  modified_base (310)..(310): a, c, t, g, unknown or other
  misc_feature (310)..(310): n is a, c, g, or t
tcagacgagtgcgtcacgaccggtgctcgatttagatcgtctgtgttggggtttgggggagtcagaccctgtcaggacacagcatggacatgagggtccccgntcagctcctggggctcctgctgctctggctcccaggtaccagctgtgacatccaattgacccagtctccatcctccctgtctgcatctattggagacagagtcaccatcacttcggccgggcagtcaggccatcagcgtattctttagccttggttgcagcaacgaaccgagggccgacgcccctgagtactcgtagtctagtggtncatccagtattggacgtaggggtcgggtcccagtccgtaggttcaggtcggactagtcgactagtcggtacgggaactaggtacttaccgaccttccgtacctaacgttataccgacgacgaacgtccagaccacgtccgttaaggtaacttacgttttacgactttaaagttttactacgtagtaactaaacgttagttaactttaaccgtaacccgttaccccggtagggttacgggtaacccggtttcgggaccgggtaacggggtaaccgtaaaggggtacggaaacgtaccggtaaaccggtattagggaccggtcgtccggtaaccg

SEQ ID NO: 215227 - DNA, 727 bp, Homo sapiens
  misc_feature: GYAE6OF01D8UIS.1.34.D01.1.454.CMB.1.raw
  modified_base (102)..(102): a, c, t, g, unknown or other
  misc_feature (102)..(102): n is a, c, g, or t
  modified_base (203)..(203): a, c, t, g, unknown or other
  misc_feature (203)..(203): n is a, c, g, or t
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgagggtccccgntcagctccgtgggctcctgctgctctggctcccgaggtaccagctgtgacatccaattcgacccagtcctccactcctccctgtctgctatcttagtgganacagtactccacctatcacgttcggccgggtacgacgtcgacggccatcgagtcgttattttccgttacggccgttaggttcgacaacggacaaacggaaccgnggggaccgacccgtcccctagacgtacgttacggtagttactggtcggtcactactaccgtagtcggttacggaccggtaacgggggttccgggtacccctaaggttccggtaaggttccggaaggttcggacgtacggtcgtacgtacggtacggtacgggaactacggttaacttaccgtacttactacctaacgtctaacggcgcctaaccgccgtagtaccgtacgaccgtttaggtaacgttttctttagatttaaacttgtacgtagtaaccttagttaacgttaccttaaccggttacccgtcccggttacggtccgggttacccggaccgggttaaccgggaacggggtaacgttaacggggaaggttcccaaaaccgggttcctaacggtgggtaccgtccgtgaaccccg

SEQ ID NO: 215228 - DNA, 710 bp, Homo sapiens
  misc_feature: GYAE6OF01AXO24.1.34.D01.1.454.CMB.1.raw
  modified_base (272)..(272): a, c, t, g, unknown or other
  misc_feature (272)..(272): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagacgtcaccatcacttcgccgggcgagtcaggccatcagcgtattcttagcctggttgcagcaagaaaccgngggcacgcccctgagtactcgtagtctagtggtgcatccgagtacttggacgtaaggggtcgggtcccagttccgaggttcgaggtcggactaggtcgacgtagtccggtaggggaactaggtaacttaccaccgttctacctacttactacgacggacgtaccgccgtgccgtaacgtccgttaaggtaacgtttacgttttacgaactttaaagtttttaacgttaaccttacggtaacctaaacgttaacgttttaacgttaaccgtttaaacccggttaaccccccgttaacggggtttaccgggtaaacccgggttttacccggggaacccgggttaaacggggggtaacccggttaaagggggtaaccggttaaaccggtaacccgttaaaacccgggtacgttagggtaccggtcgttaaccggtaacccg

SEQ ID NO: 215229 - DNA, 907 bp, Homo sapiens
  misc_feature: GYAE6OF01D73AZ.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctcgtcggcctcccgaggtaccagtctgtacgaccactacctaagttaccgaccctacgttccctccctaccttccccttccccgttgttcgtcgtactacttaccgttaaggttacgggaacgaaccgtaaggtaccgttaaccaacccgtactccgttaccgggttccggggacccggggtacggtaacgggtaccgaccgggtacctaacgtacggtaccggtaccgtttacgttttaccggttttaccggttccgggttagggttaccggacgaacggtaaccggaaaccgggtaaacccggggaccggggaccccgtaccccggtaccccgtaacgtaacggttaccggttacggttacggttacgttaggtcggtactacgtacgtacggtagttacgtcggtaacgggtaccggggttccggtacctacggtaccggtacggtacgtacgggtacggtacgacggtacgtaccgttaggtaccggtagggtaacttacgttacttaccgtaccttacctacgtaacttcgaacgacggtcacccggtcgtaaccgtcggtaacgtaccgttaaggtttaacgtttactttaacgtttaacttaacgttttaactaccggtaatttaacctaacgtttaatttacccggttaaccgtaccggttaacccggttcgggtaaccggttaccgggtaccgggtaaacgggttaacgggacgtaaccgggtacggttaacctaaccggtaccgtagggtcggttcctaggccctacgg

SEQ ID NO: 215230 - DNA, 570 bp, Homo sapiens
  misc_feature: GYAE6OF01A7MJ4.1.34.D01.1.454.CMB.1.raw
  modified_base (327)..(327): a, c, t, g, unknown or other
  misc_feature (327)..(327): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattgacccagtctccatcctccctgtctgcatctattggagacagacgtcaccatcacgttcggccgggcgagtcacggccatcagcgtatttcgtttacgccgtggttcgacagaccaacgaaaccggcgggccaccgtcccctagagtacgtcgtagtctagtggtcncactcagtagtggacgtaggggtcggtcccagtccgtaggttcgaggtcggcaggtcgctagtcgaggactagtactcactcactactancagcacncgtgacacgtacgtagtattatttacgaatttagttactactagtactaagtattactacgtaccgtacccgttaggtacggtacgtaccggacggtaagggacctaagggacgtaacgtaccgaacgtagtggtcgcgtgacccg

SEQ ID NO: 215231 - DNA, 593 bp, Homo sapiens
  misc_feature: GYAE6OF01B7Z9Y.1.34.D01.1.454.CMB.1.raw
  modified_base (146)..(146): a, c, t, g, unknown or other
  misc_feature (146)..(146): n is a, c, g, or t
  modified_base (229)..(229): a, c, t, g, unknown or other
  misc_feature (229)..(229): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
tcagacgagtgcgtcacgaccggtgctcgatttagatcgtctgtggttgggtttgggggagtcagaccctgtcaggacacagcatggacatggagggtccccgctcagctccgtggggctcctgctgctctggctcccaggtaccngctgtgacatccaattcgacccagtctccactcctccctgtcctgctatctatggagacagagtcacatcacgttggccgggngagtcgaggccatcgagtcgtatttcttagccgttggtacgcagacacgaacgngggacacgcccagagatcgtanctagtggtcncactctagagttgacgtagggtcggtaccagtccgaggttcgaggtcgcagtcgctagtcgaggacagtactacactctacactactcagctagcctagacacgtactaggtaattactttagacttaagtttacttaccgaggttaaccaatagttttaacgttacgaacccggttaccgttacggttacggtacggttaccggacccgggaaaggggttacctaggggtaacgtaaacggtaccaacggttacgacgggtaggtccacgttaaccg

SEQ ID NO: 215232 - DNA, 780 bp, Homo sapiens
  misc_feature: GYAE6OF01AHRBT.1.34.D01.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (530)..(530): a, c, t, g, unknown or other
  misc_feature (530)..(530): n is a, c, g, or t
  modified_base (757)..(757): a, c, t, g, unknown or other
  misc_feature (757)..(757): n is a, c, g, or t
tcagacgagtgcgtcacgaccggtgctcgatttagatcgtctgtgttgggtttgggggagtcagaccctgtcaggacacagcagtggacagtggacgggtcccccgctccaggcctccgtggggctccgtgctgctcgtcggcctcccgaggtaccagcctgtcgacactacctaatcgaccctagtcctccnctcccttccgtntctacgcacttcgtagtcggacgacagtacgaccactacgtacaccggttcggcccggggaacgtacggtaccgaccggacctagtaccgtacggtacgtttaccttttccgttttacggcccggtttggtacgccgaacggaccgaaacgggaacccgtcgggggacctaccccgtccccgttagaaccggttacgttaccggttacgtttagtacgggtcggtaaccgtctaaccgtacgtacgttacgtccggacgggttaccggggttaaccgggtcctacgtttacccgggaggttcgtaacgcgggtcgacggtttacnccgtaagttaccgggtagggaccttacgtaccttactaccgtcctacgtatacgtacgacgtaccgcgtcgtacgacctagtacgtaagttcttagttacactttaagtttaccttcaacggttataccgttagtttaccgtaaccttaccgggttaccgtacggtaccggttcggtaaccggtcggaagggttaaccacgggttacgaaaccggacccgttaacgngttaagccgtacgtcgtaaccgg

SEQ ID NO: 215233 - DNA, 864 bp, Homo sapiens
  misc_feature: GYAE6OF01BQGXK.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtcctccactccctccctgtctgctatcgtagttggagacagagtaccaccatacctacgttcggccggggacgacggtacgacggacctacgtacgagtccgttaattttcgtttacgccgttgggttcgaccgacggaccgaacggaaaaccggacgggccgaacccgcccccgtagaacggtacgtacggttacgttactaggtcggtactacctacgtacgtagtacgttcggacggtaacggggttccggtaccctacgtacccggttaagggttaccgagggtccgggacgtaaggtcgtacgttacgtacgggtaacgggtaactaacggttaactttacccgtaaccgtttacctaccgttaaacttacgaccgacgtacccgttacgtcccgtaacggacgtacgtaccgttaagttaacggtttagtttaacgtaacttttaaacgttttacgttaccgtaaaccgttaaacgtaagttttaacggtttaaccttttaacccgggttaacccccgtttaacccgggttaacgggttacccgggtaaacccgggttcccgggtaaccggggttaaacggggtaaccggttaacggggtaaaccgtaaccgtaacccggttaaccggtaacggttacggtccggtaacgtacccggtacctaccgttagtttcccgtacgttccttaacccgttcttaccccgtaccggtaaccc

SEQ ID NO: 215234 - DNA, 902 bp, Homo sapiens
  misc_feature: GYAE6OF01BNCYR.1.34.D01.1.454.CMB.1.raw
  modified_base (104)..(104): a, c, t, g, unknown or other
  misc_feature (104)..(104): n is a, c, g, or t
tcagacgagtgcgtcacgaccggtgctcgatttagatcgtctgtgttgggtttgggggacgtcagaccctgtcaggacacagcagtggacatgagggtccccgntcagctccgtggggctcctgctgctctggctcccaggtaccagctgtgacatccaattcgacccagtcctccatccctcctgtctgcatctagttggacgacaggacgtccaaccattccacgtttcggccggggtcgaagttccgagggcccaagttccgaaggccgtaactttccttttaaggcccgttgggtttcgaccgtacggaccgaacggaaaacccgacgggggtaccgaaccggtaccccccttacgaacgtacgttaccggttaacgttaccgttaagttcgggtacggtacctaaccgttaccgaaacggttacgtttacgggacggtaaaacgggggttccgggggttaccccctaacggttacccgtaacggggtttttacccgaacggggtttaccgggacgttaacgggttacggtacccgttaaaggttcccggttaacgggggtaacctaaacgggtttaaccgtttaacccgtaccggtttcctaaacccgtaaccgtttaacgtaccggttaacgggaccgtaaacggtcccgttaggacccggtacgtaccccggtagggttaaaaccgtttagttttaccgaacgttttaaactttttaacgttaccgtacggtaacctaaacgttaacgttaacgttacggtaacccgtttacccgtaggttaccgggtaaccggttacccgggtaaccggtaaaggggtaacccgtaaggggttaacggtaaaccgttacccggaaaaccggttacgttagggtaccgtcgttaccgaaccccgg

SEQ ID NO: 215235 - DNA, 761 bp, Homo sapiens
  misc_feature: GYAE6OF01AD86E.1.34.D01.1.454.CMB.1.raw
  modified_base (752)..(752): a, c, t, g, unknown or other
  misc_feature (752)..(752): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgctatctagttggacacagagtccacatcgacgttcggccgggactacgtcaggccatcgagtctagttctttagccgtggttcgcgacgtacgaaacggaaacccggacggggaccgaaccgtacccccgtacgaaggtaccgttaccggttaacggttaccgttaggttacggtacgacctacttaccgaagtacgttacggacggtaaacggggtccgggtaccctacgtcccgtaggttcgtacgggtcgaccgtaggtaccgacgtacgtaccggtagggtaaccgaagtacctttaccgaccttcgtaactaaccgttacgaccgagtcccgtaacgcccgttaggacccgttacgaaccgttaaggtaacgtttagttttaccgtaactttaacttttaaccgtacttacgttaaactaagttacgttaacttacggtaacccgttaccggttacggtacgggttacccggttaccgggaaccgggtacgggtaaaccggtaggggttaaccgttaaaccggtaccgtaaacccggttaggttaccggaccgggttacncgtaacccg

SEQ ID NO: 215236 - DNA, 762 bp, Homo sapiens
  misc_feature: GYAE6OF01BWOXX.1.34.D01.1.454.CMB.1.raw
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattcgacccagtcctccactccctcctgtctgcatctagtggagacagatacacatcacgttcggccgggacgagtcgacggcctagtcagtcttatttcgttagccgttggtgcgagacgaacgaaaccggcgggaccgaccgcccctagaacgtacgttcggtagttcgtagtgggtacacctaacgtcgtagtacgttcggaacggtaacgggggttccgggtacctacgttcccggtaaggttaccggacgggtacggtccgtaagggtccgtaccgtaacggtcgggtacggggaactaaacgttaaccgtttaaccgtaaccgttacctaccgttaaacttaacgtaaccgtacggaacctaccggtaccgtaccgtaccggtacgttaaccgttaaggttaaactttgttttaacggtaacttttaacgttttaacgtttaaccgtaggttaaacctaagtttaaacgtttaccttaaccggtttaacccgttaccccgttagggttaccgggtaccggttacgggacccggtaacggggtacggtaacgggtacgtaacggtaaccgaacgttacggtaggtcggtacgcggtaacc

SEQ ID NO: 215237 - DNA, 750 bp, Homo sapiens
  misc_feature: GYAE6OF01BRUNH.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctcgtggctcccaggtaccagctgtagacatccaattgacccagtctccactccctccctgtctgcatctagttggagacagactcaaccatcctacgttcggccgggtcgagtcgaggaccatcgagtacgttactttacgtttacggtccgttggttcgaccgagaccaaacggaaacccgaggggaccgaccgtccccctagaagtacgttacggtacgttacgtagttcggtacacgtaacttacgagttagttacggaacggtacggggttaccggtacccctaagttcccggtaaggtacggtacggtcgggtacgtagtacggtatacggtacggtacgggaccttaacgtacttaaccgtacttccgtacctaacgttactacgaccgacgtacgtccgtagacctacgtactaaggtaacgtttagtttacctaagtttaacttttaaccgttacgtacgtttaactaacggttaactttacgttaaccttaaccggttaacccgttacggtaacggtaccggttacgggacccggtaaaggggttacccggaagggtaacccggtaacggaaaccgttaacccggaggttccgggttaactcggtaacgtacccg

SEQ ID NO: 215238 - DNA, 950 bp, Homo sapiens
  misc_feature: GYAE6OF01CRQFR.1.34.D01.1.454.CMB.1.raw
tcagacgagtgcgtcacgaccggtgctcgatttagatcgtctgtgtttgggtttgggggagtcagaccctgtcaggacacagcatggacatgagggtccccgctcagctcctggggctcctgctgctctggctcccaggtaccagctgtgacatccaattcgaccagtctccatcctccctgtctgcatctagtggagacagacgtaccaaccattccacgttcggccggggcgtaacggtccgacggcccagtcgaggtaccgtaacttttccgtttaacggtccgttgggttacgaccgacggaccgaaacggaaaaacccggacgggggtacccggaacccggtcccccccgtacgtaacggtaacgtttaccggttaacgttaccgttaggttgggtacgtaccgtaacgtacccgtaaggttacggtttacgggaaccggttaaaccggggggtttccggggttaacccccttaaccggtttaccccggttaaggggttttacccggaacgggttacgggtacccgttaaggtcgggtaaccgttacggttaccgggtacggggaacttaacgggttaaaccttttaacccgaaccctttccccgtaaccgttaaaccttacgtaccgtaacggtacccgtaaccggtcccgtacggtaccgtaaccggttacccgttaaaggttaacgttttaacgtttttaaccgttaacgtttttaaacgttttttaacctttacgggtttaaccttaaaccggttaaaagtttaacggttttaaacgtttaccgtttaaaccccggttaaccccgttacgggtttaacccggggtacccgggtttacccgggaaccgggttaaccggggggtaaaccgtaacggggttaacggtaaacccggttacccggtaaaaccggtacgttacggggtcgtaaccgttccgtacccg

SEQ ID NO: 215239 - DNA, 737 bp, Homo sapiens
  misc_feature: GYAE6OF01BBQAD.1.34.D01.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccatccctcctgtctgcatctagttgganacagngtccaccatcacgttcggccggggngagtccacggccatccgagtcgtactttcgttttacggcccgttgggttcgctaggaccaaacgaaacccggtaggggacccgaccgtccccctacgaaggtacgtccggttagttcctaggtgggtcgacctaacttcccgaagtacgtttacggacggttaacggggtccgggtacccctaggtccgttagggttcgtaaggttcggactaggtcgacttagtcggtagggaactagtaccttaactacctcgttactacgtaatcgaactaccaccgtaccgtcgtacctaacccggttcggtaacgtaagggttttacttttacggtaacttttaacgtttaacttaccggttaacttaactaaacgttaagtttaacttaccgtacccgggttaacccgtaggttcccgggtaaccggttccgggaaccgggtaagggtaaccgggtaggtaacggtaaccgtaaccggtaacggttacgtgggtactccggtacgtaccc

SEQ ID NO: 215240 - DNA, 648 bp, Homo sapiens
  misc_feature: GYAE6OF01EG6DF.1.34.D01.1.454.CMB.1.raw
  modified_base (196)..(196): a, c, t, g, unknown or other
  misc_feature (196)..(196): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctccaggtaccagctgtgacatccaattcgacccagtctccatcctcctgtctgcatctatgganacagagtcaccatcacgttgccgggcagtcaggccatcagctattcttagctggtgacagacaacgaaaccgngggcaccgccctagagatccgtatctagtggtnacactcgagtagttcgaacgtaggggtcggtacctagtccgtaggttcaggtggacagtacgctacggtcgtagggaactagaactttaaccaccgttacctactaacctaactcgaacgtacgacgcccgtgaccgacgtaccggtaagtaaacgtttagtttacgtattaaacgttttaactttacgtacgttaactaacgttaagttaacttaacgttaacccgttaacccggtacggttacgggtacccggtttaccgggaccgggtaacggggtaacgtaaacggggtaacgaacggttaaccaaaccggtaacggttacgggtacgtacgttcgaacccg

SEQ ID NO: 215241 - DNA, 881 bp, Homo sapiens
  misc_feature: GYAE6OF01AF6Q5.1.34.D01.1.454.CMB.1.raw
  modified_base (631)..(631): a, c, t, g, unknown or other
  misc_feature (631)..(631): n is a, c, g, or t
  modified_base (684)..(684): a, c, t, g, unknown or other
  misc_feature (684)..(684): n is a, c, g, or t
  modified_base (759)..(759): a, c, t, g, unknown or other
  misc_feature (759)..(759): n is a, c, g, or t
  modified_base (875)..(875): a, c, t, g, unknown or other
  misc_feature (875)..(875): n is a, c, g, or t
tcagacgagtgcgtcacgaccggtgctcgatttagatcgtctgtgttgggtttgggggtagtcagacctgtcaggacacagcatggacatggacgggtcccccgctcagctccgtggggcctcctgctgcctcgtcggcctccccgaggtacccagctggtcgactataccctaaagttccgacccagtcctaccctacttccccttcccttgtccttacgacctattccgtagttcgggaactaaccaggtagtacccaactaacttccgtaacgttccgggcccggggggtacctaaggttccgaacgggtccctaacgttccgaacggtccgttaacgttttaccgttttaacggtcccgtttacggggttaccgaccggtaacgtaaccgtaaaccggtaaaacccgggtcggggaaccccggtaccccggtaccccccgtacgtaacggtaccgttaccgggtaccggttacgttaacggtcggggtaaccggtcccaaacggttcccgaaggttagtttaccggaaccgggttaaccgggggttcccggggtaacccctagtacccgggtacggtttacggtcgggtcggactaggggtcaccgtacggttccggacggggtaanacggtacgtttaccaccgttactacgtaacttaccgaaggtacgaccgtaccncccggtacgaccgtaccggtactaaggttacgtttagtttaccgtaactttagtttaaccttacgtaaccgttanaacggttacgttaacttcgtaaaccgttaccggtcggttaacccgggtccggtaccggttacgaaccggggttaggaccggttaaggtcctaacgtacggacggttagcggtaacncgtacc

SEQ ID NO: 215242 - DNA, 710 bp, Homo sapiens
  misc_feature: GYAE6OF01APP4L.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactccctccctgtctgcatctagtggagacagacgtaccaccatcacgttcggcccgggcgacgtccgacggccataccgagcgtaactttctttacggtccgttgggttcgacgacgaccgaaacggaaacccggacgggggaccgacccggtaccccctacgaacggtaccgttcggttaacgttccgttaggtcgggtacgacctaacgtcccgtaagtacggtttcggacgtaacgggggtccggtaccctagtcccggtaggttacgacggtcgacgtagtcgactagtcggaggactagtactacactctactactacacgacgcacgtccgtcgacgtacgtcgtagtaagttctttaacgtactttaatttacgtacgtacgttactaactacgttaacttaccgtaccgttacccgttagggtaccggttaccgggtaccgggaacccgggtaagggaaccggttaaagggttaccggtaaaccgtacggtaaaacccgtaggttacggtcggtccgtacggtaacccg

SEQ ID NO: 215243 - DNA, 1101 bp, Homo sapiens
  misc_feature: GYAE6OF01CK8FJ.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctcctggggctcctgctgctctggctcccaggtaccagctgtgacatccaattcgaccagtctccatccctccctgtctgctactctagttggatacgagtacgtaccaacctactaccgtacgtttccggaccgggggacgtaacgtcgaccgggaccagttaccgacggtccggttaacttttcccgtttaacggtcccgttttacggggttcgaccgtaaacgggacccgtaaaaccgggaaaaccccgggtacgggggaccccggtaaccccggtaccccccgttaaccgtaagggttaaccgtttaccgggttaacggtttcccgtttaagggttacggggtacctaccggttaaccgttaacccggtaaagggttaaccgtttacgggaaccgggtttaaaccggggggttacccggggttacccccgttaaccggtttaccccgggttaacggggtttaaccgtaacggggtttaccgggaacgttaacgggttaccggtacccgtaaacggttccgggttaacggggaaccgttaaacgttaaccgtttaaccctacccggtttaccccttaaacccgttaccggtttaaaactccggaaccgggtacccgttaccggtaccccggttaccgtaccccgggttaaaccgttccccgggtttaaaagtttaaacccggttttaacttttaaccgtaaaccggttttttaaatttttaacccggtaaccggtttacgtaaaacctttaaacggtttaaacgggttttaaccttaacccgggtttaaacccccgttttaaccccgggtttaacggggttaccccgggggtttaaaccgggttaccccccgggggtaaacggggtaaaccccggggggtttaaacgtaaaccgggggggtttaaacgtaaaaccccgggttaacccgggttaaaaacccggttgggttaacggggtccccggttaaacggtcccggtaaaacccccggg

SEQ ID NO: 215244 - DNA, 862 bp, Homo sapiens
  misc_feature: GYAE6OF01DGZ59.1.34.D01.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (839)..(839): a, c, t, g, unknown or other
  misc_feature (839)..(839): n is a, c, g, or t
tcagacgagtgcgtcacgaccggtgctcgatttagatcgtctgtgttgggtttgggggagtcagaccctgtcaggacacagcatggacatggacgggtccccgctcagcctccgtgggcctcctgctgctcgtggcctcccgaggtaccagctgtcgactataccaattcgaccctagtcctccatccctcctgtctgacnttactagtgganacgagacgtaccaccattccgaacgttcgggcccggacgtaggtccgaggtaccatccggaacgaccggttattttaccgtttacggtccgttacggttcgaccgaacgaaccgtaacggaaaacccgggaggggaccccgaaccggtcccccgtaacgtaacggtacgttaccggttacgttaccgtagttacggggtacaccgtacgttaccgaagtacgtttcggaaccggtaacggggttccgggtaccccttaacgttacccggtaagggtttaccggaacgggtcgggtacgtaagggtcgtaccggttaacgtcgggttaacgggggacctaaggttaacctttaaccctaccggtttaacctaaccttaacgttacccgttacgaacgtaccgtaacgttcccgacgtaccgttaacgtacgttaacggttaacgttttactttaacgttaaactttaacgttttaacgtttaccggtaacgtttaactaaaccgttaaggtttaaactttacccgtaaacccgtttacccggtacggttaccggtacccgggttaccggaaccgggtaacggtaccgggtaaagggtacggtaacggtaaccctaaacccgggttanagggttccgtacgccggtaaccc

SEQ ID NO: 215245 - DNA, 690 bp, Homo sapiens
  misc_feature: GYAE6OF01A3BLQ.1.34.D01.1.454.CMB.1.raw
  modified_base (281)..(281): a, c, t, g, unknown or other
  misc_feature (281)..(281): n is a, c, g, or t
  modified_base (443)..(443): a, c, t, g, unknown or other
  misc_feature (443)..(443): n is a, c, g, or t
  modified_base (677)..(677): a, c, t, g, unknown or other
  misc_feature (677)..(677): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactccctccctgtctgcatctagtggagacagagtcaccatcacgttcggccgggcgagtcaggccatcagcgtattctttagccttggttcgcagcaacggaaaccgnggggccacgcccctagaggtacttcggtagtctagttcgggtgactaactccgagtattggaccgtaagggggtcgggtacccagttcccggaggttcaggtcggacagtacgctaagtccggtagggaactaggtacttacgaccttaccactaccgttanaccgacgacgaccgtcccgttaggcccaacggtccgtaaggtaacgtttagttttccgaactttaacttttacttacgttacgtaacctaaagttaacgtttaacgttaacggttacccgttaaccccgggttaggttaccggggtaacccggtttccgggacccgggtaaacgggggtaactaaacggggtacggtaaaacgtacccgtaaaccgggtagttagggtcccggngttacgaaccccg

SEQ ID NO: 215246 - DNA, 694 bp, Homo sapiens
  misc_feature: GYAE6OF01BTE85.1.34.D01.1.454.CMB.1.raw
  modified_base (306)..(306): a, c, t, g, unknown or other
  misc_feature (306)..(306): n is a, c, g, or t
  modified_base (467)..(467): a, c, t, g, unknown or other
  misc_feature (467)..(467): n is a, c, g, or t
tcagacgagtgcgtcacgaccggtgctcgatttagatcgtctgtgttggggtttgggggagtcagtaccctgtcaggacacagcatggacatgagggtcccccgctcagctccgtggggctccgtgctgtcctcgtggcctacccaggtaccagtcctggtacgacatccaattcgaccagtctaccatcccgtcctgtctgcatctaggtggacgacagactcaccatcacgttcggccggtgtagtcacggcctagtcacgtcgtattcgtttacgccgttggtgaccaagacaacgaaaccgngggaccgacgccccgtgacgtagtccgtagtctagtggtcacgtatcgagtattcggaacgtaaggtcggtaccaagtccgacggttacgacggttggactacgttcgacgtacgtttccggagggtactaacggtacttaacgccgttacctactaactntaccgaagacctaacgccgtaggacctaggtaacctaggtaaacgtttactttagggaacctttaatttaccgtaacgttccgttaaccgaaaacgtttgttaaacctttaccggtaacccttacccgggttaaggttaccggtaaccggttccgggtaaaccggacggggtacgtaacggggtagtaacccgtaaacgaccggttatacgggcgtacgcggtaacc

SEQ ID NO: 215247 - DNA, 977 bp, Homo sapiens
  misc_feature: GYAE6OF01ALOQ9.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcactcttagtggacgacagacgtaccaccactctacgttcggccgggcgacgtcgacggccatcgagtacgtacgtttctttacgtccgtggttcgacgacggaccgaaacggaaacccggacggggtaccgacccggtacccctacggaacgtacgttaccggttacggttaccgttaggttacgggtcgacccgtaccgttcccgtaaaggttacggtttaccgggaaccggggttaaccggggggtttaccccggggggttaaccccttaaccgttaacccggggttaaacgggtttcggtacggggttacggtaccggttaacggtccggtaccgttaccgggttaccggggtaaacggggtaaaccgttaaggttaaacctttaaccgtacccttccccgttaactaaccgtttacgaaccgtaccgtacccgaacccgtcccgtacggacctaccggtaccgttaaggtaaacttttcgttaaccgttaaacttttaactttttaccggtaacgttaccgttaaaccttaaacggttacttttaaaccgttttaacccggtttaacccccgggtttaacccgggtttaccgggttaacccggggtttaccggggttaaccccgggaacccgggggtaaaccgggggtttaaaccggtaacggggttaaaccgggtaacccggtaaaacccggttaacggggttaccgttacggggtcccggttcccgttaacgggaccccttaaccggttcgtttacccgttttacggttacccctttaaccggtttccccttcccggtttaccccgaccg

SEQ ID NO: 215248 - DNA, 671 bp, Homo sapiens
  misc_feature: GYAE6OF01BFUPC.1.34.D01.1.454.CMB.1.raw
  modified_base (202)..(202): a, c, t, g, unknown or other
  misc_feature (202)..(202): n is a, c, g, or t
  modified_base (341)..(341): a, c, t, g, unknown or other
  misc_feature (341)..(341): n is a, c, g, or t
tcagacgagtgcgtcacgaccggtgctcgatttagatcgtctgtgttgggtttgggggagtcagaccccgtcaggacacagcatggacatgagggtccccgctcagctcctggggctcctgctgctctggcctcccaggtaccagctgtgacatccaattgacccagtcctccactccctccctgtctgctatctattgganacagagtccacctatccacgttcggcccgggcgagtccacggccagtcacgcgtatttctttacgccgttggttgcagacaacggaaaccgtaggggccgaccgcccctagaagtacgttcggttagtcttagtcggtnacctatccgaagtacttggacgtaacgggtcggggtacccagtccgaggttcgaggtgcgtagtcgacctgtacggtgggaacaacgtaactttccgaccttaccgtactaacttgacccaggccaccgtccttacgaccgtgtacccgtagtaagtttactttagaacctttaatttacttaaccgtcgtaactaacgttatttaactaccgttaaccgttaccccggttagtccggtaacggttcccggacggaacggggtaagttaacggggtaacgaaccgttaaccggaaacgtacgttagggacctccgttacgaccgtacccg

SEQ ID NO: 215249 - DNA, 705 bp, Homo sapiens
  misc_feature: GYAE6OF01A1CNS.1.34.D01.1.454.CMB.1.raw
  modified_base (104)..(104): a, c, t, g, unknown or other
  misc_feature (104)..(104): n is a, c, g, or t
  modified_base (149)..(149): a, c, t, g, unknown or other
  misc_feature (149)..(149): n is a, c, g, or t
  modified_base (207)..(207): a, c, t, g, unknown or other
  misc_feature (207)..(207): n is a, c, g, or t
  modified_base (697)..(697): a, c, t, g, unknown or other
  misc_feature (697)..(697): n is a, c, g, or t
tcagacgagtgcgtcacgaccggtgctcgatttagatcgtctgtgttgggtttgggggagtcagaccctgtcaggacacagcatggacatggacgggtccccgntcagctccgtggggctcctgctgctcgtcggcctcccaggtaccngctgtgacatccaattcgaccctagtcctccactccctcctgtctgctatctatgganacagctcacatcgtacgttcggccggtagagtccacggcctaagtcgaagtcgtactttctttacggtccgttggttcgacaagaccgaaacggaaaccggcggggaccgacccgtcccctacgtaacggtacgttacggttacgttacgtaggtcgggttcactactaccgaggtattcggacggtacggggtccggtaccctagtcggtaggttcgacggtacggacgagtcgacgtacgtcggtaggtaactacgttaacgttacctaccttacgtacgtaccttactaccgaacgcgtacgtccgtagaccgtacgtcgtaaggttaagtttactttacgaacttttaacgtttacgttacgtacgtaaaccgtaacgttaacgtttaactaccgttaaccggtacccttacgggtcgtaaccgggttcggaaccgggtagggaaacctacgggtagtaaccgacgtaacgtacgtaggtccgtanccgtaacc

SEQ ID NO: 215250 - DNA, 713 bp, Homo sapiens
  misc_feature: GYAE6OF01BBOUC.1.34.D01.1.454.CMB.1.raw
  modified_base (208)..(208): a, c, t, g, unknown or other
  misc_feature (208)..(208): n is a, c, g, or t
  modified_base (471)..(471): a, c, t, g, unknown or other
  misc_feature (471)..(471): n is a, c, g, or t
  modified_base (520)..(520): a, c, t, g, unknown or other
  misc_feature (520)..(520): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctctgctgctctggctcccaggtaccagctgtgacactccaattcgaaccctagtcctccacttcctccctgtctgctatctagtggacgacngactcactatcgacgttggccgggacgtacgtcgacggccaactcgaagtcgtactttcgttacgtccgtggttcgacgaggacaacggaaaccgcgggggaccaaccggtccctacgagttacgtaccgttagtcctaggttcggacgcgtacaccgtagtacttaggacggtacggtcggcctacgtacgtaggttcaggtcgctagcgatcgttaacgcggtaacgtactaacgttacctacgtactcgtaactacgacncggtacacgtctcggaaccgcgtacgttacggtaaatttacggtttaanactttaaacgtttaacttacgttaacgtacctaaattaacggtttaacgtaaccgtttaaccgggtaaccctttaccgggtaaaccggttaccgggtttacccggggaaccggtaaaggggacccgtaaacggggttaccgggaatttaaacccggaccggttaaactggggtcccacgggtttacaacccgg

SEQ ID NO: 215251 - DNA, 749 bp, Homo sapiens
  misc_feature: GYAE6OF01B3FLQ.1.34.D01.1.454.CMB.1.raw
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgcctctggctcccgaggtaccagctgtgacatccaattcgacccagtctccactccctccctgtctgcatctagtggagacaggactcaaccagtcctacgttcgggccgggcgaacgtcagggaccatcagctattcttagcgtggtncagcaagaaccgngggcgacncccgtnagtactcggtatctagtggtcnctaatccgtaagagttacgaggtaacgggggttcggccctaaggtcccgtaagggttcaaggggtggaaccgaggttacgacgtaacgttcggtaggggtaactaacgttaacttaaccctacttacctaccgtaactacgtaacgtacgaccgtacgtcccgtacggaccgtaaccggttaccgttaaggtaaacgtttacgttttaacgtaacttttaaacgttttacgttaaccggttacttaaccgttaaacgttaacgtttaacttaccggttaaaccccgttacccgggttaacgggttacccgggttaaacccggggtttaccggaacccggggttaaacgggggaaacgttaaacggggggtacaaacccggtaacggtaaacccgtagggttacggcgggttaccgtcgtaaccgg

SEQ ID NO: 215252 - DNA, 526 bp, Homo sapiens
  misc_feature: GYAE6OF01BZDAD.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcgagtcaggccatcagcgattctttagcctggttgcagcagaaaccagggccagcccctgagactcgtagtctatggtgcatccagattcggactaagggtcgggtccccaagtccgaaggttcaggtggcagtgcatcgtagggacagtattacacgtctactactatacagtacagcctgcacgcctagaacgtatttcgactaattttatactgtacaactagtatatacgtacccgtagtcggtacgttcggaccgaagggacctaaggtggaataccgtaacgaacttcggtagcgtgacc

SEQ ID NO: 215253 - DNA, 744 bp, Homo sapiens
  misc_feature: GYAE6OF01D9IJY.1.34.D01.1.454.CMB.1.raw
  modified_base (105)..(105): a, c, t, g, unknown or other
  misc_feature (105)..(105): n is a, c, g, or t
  modified_base (574)..(574): a, c, t, g, unknown or other
  misc_feature (574)..(574): n is a, c, g, or t
tcagacgagtgcgtcacgaccggtgctcgatttagatcgtctgtgttggggtttgggggagtcagaccctgtcaggacacagcatggacatggacgggtccccgntcagctccgtggggctcctgctgctctggctcccaggtaccagctgtgacatccaattcgacccagtctccactcctccctgtctgctatctattggagacagacgtccacctacgtcctacgttcggcccgggcgtacggtcgacggacctagtaccgagtcgttatttccgttaggtccgttggttacgacacgacgaacgaaaccgaggggacccgaccgccccgtagacggtacgttaccggttacgttcgttaggtcggtcgtactactaccgtagttagtcggacggtaacggggttcccgggtacccgtacgttaccggtacggttcgtacgggttcggacgtacggtccgtacgtagtaccggtaacgggaacgtacggtaaccttctaacccgttacctacgtaccttaacgtcgtaacgcgtaacctccgtagaccgtacgtaccgtagtaaacgtttntttacgaacttttaagtttacgttacgtacggttaactaaggttattaaccgttaacgttacccggttaacccgttaggtcccgggtacggttaccgggaccggtaacgggtaacgtaacgggtacgtaacggtaaccgtaaccggtacggttggactccggtgtaaccc

SEQ ID NO: 215254 - DNA, 763 bp, Homo sapiens
  misc_feature: GYAE6OF01B9PMS.1.34.D01.1.454.CMB.1.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
tcagacgagtgcgtcacgaccggtgctcgatttagatcgtctgtgttgggttgggggagtcagaccctgtcaggacacagcatggacatgagggtccccgctcagctccgtggggctcctgctgctctggctcccagtaccagctgtgacatccaattcgacccagtctccatcctccctgtctgctatctatggagacagagtcaccatcacgttggccggnagtcacggccatcagcgtatttcgttacgcctggttcgcganacgaaagaaacccgagggaccacgcccctacagtactacggtagtcctagtcggtcactactaccgagtagttcggacgtaacgggtcgggtacccctagtaccgaacggttcgaggttcggactaggtacgctaacgtaccgttagggaacctagtaacgttacctaaccgttaccgtacctaactaaaccgtaccgtaacgtaccgtaacgtacccgttaacggaccgtaacgtaccccggttaagtaaacggttttaacttttttaacgggaaaccttttaaaacgtttttaaacctttaagttacccgtaacgtaaaaccgttaagtttaactttaaccgttaacccggttaaaccccccgtttaaccgggttaccggttaaacccggtttcccgggtaaaccgggtaaaccggggtaacccggtaaacggggttaaacggaaccgtaaacccggtaaacgaaccggttaggtaccggtacgtacggaaacccg

SEQ ID NO: 215255 - DNA, 733 bp, Homo sapiens
  misc_feature: GYAE6OF01BLY5I.1.34.D01.1.454.CMB.1.raw
  modified_base (126)..(126): a, c, t, g, unknown or other
  misc_feature (126)..(126): n is a, c, g, or t
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggttgggggagtcagaccctgtcaggacacagcatggacatgagggtccccgctcagctcctggggctcctgctgctntggctcccaggtaccagctgtgacatccgaattgacccagtcctccatcctccctgtcctgcatctattgganacagatcaccatcacgttgccgggcagtcaggccatccgagcgtattcttacgcctggtacagcaagaaccgnggccgacgcccctanagactacgtagtcgtagtggtagctagtccagtactgacgtagggtcgggtcccagtccgtaggttcaggtcggactaggtcgctacgtcgtacggactaggtacttactaccgttactactaactagtacacgtacacggtccctacgcctacggtacccgtaaggtaactttacgtttttacgaactttaacgtttttaacgttaacccgttaggttaaacccttaaaggtttacggttttaaaacgtttaacccggtttacccggttaaaccccccggttaacgggtttaccggggttaaacccgggtttaacccggggaaacccgggtaaccgggggtaaacccggttacgggtaaaccggggttaaacccgttaaaccggtaaaaccccggttacgggttacggttaacccgggtaacggttcccggtaaacccgtaacgg

SEQ ID NO: 215256 - DNA, 766 bp, Homo sapiens
  misc_feature: GYAE6OF01DF2CW.1.34.D01.1.454.CMB.1.raw
  modified_base (569)..(569): a, c, t, g, unknown or other
  misc_feature (569)..(569): n is a, c, g, or t
  modified_base (756)..(756): a, c, t, g, unknown or other
  misc_feature (756)..(756): n is a, c, g, or t
tcagacgagtgcgtcacgaccggtgctcgatttagatcgtctgtgttgggtttgggggagtcagaccctgtcaggacacagcatggacatggacgggttcccccgctcagcctccgtggggcttcctgctgctcgtggctcccaggtaccagctgtgactactaccaattcgacccagtcctccacttccctcccttgtcctgactattcttagttaggacaacaggacgtaccaacctatcgtaaccgttcgggaccgggacgtacgccgacgggaccctataccgaaggtccgtaattttccgtttacgccgttgggttcgaccaaggaccgaaacggaaaaccggacggggccgaacccgcccccttagaacggtacttaccggtaatttccgtaagttcggctaacgactaccgtaagtagttcggaacggtaaacgggggtccggtacccctacggttaccggtaacggtttcgaacggttcggacgtaaggtcgtaaccgtacgttcgggtaacgggaactaacggttaacttacccaaccgttccgtaactaacccgttaanaccgaacgccggtaaccgcctaggggtacccaggtaccttaagggtaaacgtttcttttagaaccttttaaagtttacttaaccgttacgtaacctaaagttaattaacgttaataaccgtaacctacggttacgtacgggtaccgtccggagaacggggtacctaggtaagacgtacaacggttanggtcgctacg

SEQ ID NO: 215257 - DNA, 545 bp, Homo sapiens
  misc_feature: GYAE6OF01DJI02.1.34.D01.1.454.CMB.1.raw
  modified_base (176)..(176): a, c, t, g, unknown or other
  misc_feature (176)..(176): n is a, c, g, or t
  modified_base (252)..(252): a, c, t, g, unknown or other
  misc_feature (252)..(252): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
  modified_base (507)..(508): a, c, t, g, unknown or other
  misc_feature (507)..(508): n is a, c, g, or t
  modified_base (510)..(514): a, c, t, g, unknown or other
  misc_feature (510)..(514): n is a, c, g, or t
  modified_base (516)..(545): a, c, t, g, unknown or other
  misc_feature (516)..(545): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagtattgcaagggtggggtcccatccaggttcagtggcngtgcatcgtgggacagtattacactcacactatcagcagcctgcacgcctgaagttatttgctaattttacttacngtacaactagtatttactacgtaccctaggtgtacggttccggacggaggggactaagggacggacgtaccaaccgtagttgtcggctgacctacctattaccgtcgttaccttctaacttccccgttaccccggacctacgtttaaccgacggtaaccgtcccgtaccgttcccgggtttggaacgggtacggtcccggggtacggttacggacccgggttaacgggcggtacgtagtaacggntaagcgcngnncnnnnngnnnnnnnnnnnnnnnnnnnnnnnnnnnnnn

SEQ ID NO: 215258 - DNA, 664 bp, Homo sapiens
  misc_feature: GYAE6OF01ADT9Z.1.34.D01.1.454.CMB.1.raw
  modified_base (197)..(197): a, c, t, g, unknown or other
  misc_feature (197)..(197): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
  modified_base (378)..(378): a, c, t, g, unknown or other
  misc_feature (378)..(378): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctatggagacagagtcaccatcacgttgccgggngagtcgacggccatcagtcgtatttctttagccttggttcgcagcaagaaaccgnggggccacgcccctanagatcgtagtctagtggtnactactccgagtacttcggacgtagggtcgggtacccagtccgtaggttcgaggtcgcgagtcgactagtcgtaggaactagtacttaacnctctactaactcacgacgcacgtccgtgactacgccgttaagtaagttctttacgaatttaacgttttatacgtacgttacaaacgtagtttaacgttaacgttaacccggttaccccgtaggttaccgggtaccggtttaccgggaaccggtaacggggtaacgtaacggggtaaccgtaacggtacccgtaaacccgggtagttgggtccggttcgtacgtacccgtaccgtacgtttacgtaccgtttcctaactaccccgtttccctaccccgttaaccccc

SEQ ID NO: 215259 - DNA, 814 bp, Homo sapiens
  misc_feature: GYAE6OF01D6JBT.1.34.D01.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctcgtggctcccaggtaccagctgtgacataccaattcgacccagtctccatcctccctgtctcgcatctattgganacagagtcacctatcacgttcggccggacgagtcgacggccatcagtcgtatttctttacgccgtggttcgcagacgaacgaaacccgaggggccgaccgccccgtanaagtacgtaccgtagtccgtagtggtcgactactccgtaagtagttcggaggtaacggggtcgggtacccctaagtccgtaagggttccaggtggctaacggtcgacgtacgttcggagggtaactaaggtaaccttaccaaccttcgtacctacttaaacgtccgaacggtccgaacggtcccgtgaacccgttacgtacccgtttaagggtaacgttttaacgtttttacggtaacctttttaaaagttttaaccgtttaacccggtttacggttaaaaccttaaaacggtttaacgtttttaaacgtttaacccggtttaacccccgggttaaccccggtttaaacggggtttacccgggttaaccccggggttttaccggggaaccccgggttaaacggggggaaacccggtttaaacgggggtaacgggttaaaccggtaaacccgggttaaaaccgttacgggttaccggttacgggtacccgtacggtaacccccgg

SEQ ID NO: 215260 - DNA, 842 bp, Homo sapiens
  misc_feature: GYAE6OF01BEFFF.1.34.D01.1.454.CMB.1.raw
  modified_base (104)..(104): a, c, t, g, unknown or other
  misc_feature (104)..(104): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
  modified_base (830)..(830): a, c, t, g, unknown or other
  misc_feature (830)..(830): n is a, c, g, or t
tcagacgagtgcgtcacgaccggtgctcgatttagatcgtctgtgttggggtttgggggatcagaccctgtcaggacacagcagtggacatggacgggtccccntcagctccgtgggctcctgctgcctcgtcggcctacccgaggtaccagtctgtacgactactacctaagttcgaccctaggttccctccctacttccccgtcccttagtctcgacctattccgtagttagggacacgaggtactccaccattcctacggttccggccggtacgacgtacgacggtaccaagtcgacgtcgttaacttttccgttacgccgttggtcgacaacggaccgaaacgggaaccggcggaccncccgtaccctagaacgttacgttccggtaagttacgttaggtcggtaccnccgttaacgtaccggttaagttacggttaccggggaaccggttaccggggggtttacccggtaacccttaaccgggttccggtttaaggggtccgtaggggtaccctaggttacgtcgaacgttcggttaccgggaaacggacttacggttacttaccctaccgtttccgaacttaacgtaccctaggaacccgtcgttaccggccctgggaacctaccggttacggttagttaacggtttatttcgggtaaaaccttttcgtttaaccgttaccgtttaagacccgtttaaatttcgggtttaaacccttaggtacccccggttaccggttacggttcggtacccgggtaggaaacccggtaggtaaccgggtaacgtacgaaacccgttacgaacggtttaccgggtagtacccgnggttccgaaccg

SEQ ID NO: 215261 - DNA, 797 bp, Homo sapiens
  misc_feature: GYAE6OF01DD0JM.1.34.D01.1.454.CMB.1.raw
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
tcagacgagtgcgtcacgaccggtgctcgatttagatcgtctgtgttgggtttgggggagtcagaccctgtcaggacacagcatggacatggacgggtccccgctcagctccgtgggctcctgctgctctggcctccaggtaccagctgtgacatacctaattcgacccagtcctccacttccctccctgtctcgctattctagttggaacgtacgagtacgtaccaaccgtacttaccgaaccgtttcgggacccggggacggtacggtaccgaacgggccctagttccgaacggtaccgttacgttttacgttttacggtcccgtttgggttaccgacgtaacgtaccgaaacggaaacccggacgggaccccgaaccgtaccccgtaaccgtaaggtacgttacggttacggttacttaggtacgggtactaccgtactaccgagtacgttacggacgtaacggggttccgggtacctagtccggttaggttacgacgtcggactaggtcgaacgtacgttcggaacgacgtagtaacttaccgtactcctanaacttnaccgaacggtccacggtcgtacgaccgacgttaccgaagtttaacttcgtttacgaacttttaagttttaccgactttacgtaacttaacgttacgttaactttacctaaaccggttaccccggtttagaccgggttaccggttacccggggaagtaaccggggttacgaaacgggttaccggaaaccgttacccggaaaagggttccttagggtaccggtcctcgggtaaaccc

SEQ ID NO: 215262 - DNA, 631 bp, Homo sapiens
  misc_feature: GYAE6OF01BA32W.1.34.D01.1.454.CMB.1.raw
  modified_base (294)..(294): a, c, t, g, unknown or other
  misc_feature (294)..(294): n is a, c, g, or t
  modified_base (496)..(496): a, c, t, g, unknown or other
  misc_feature (496)..(496): n is a, c, g, or t
tcagacgagtgcgtcacgaccggtgctcgatttagatcgtctgtgttgggtttgggggagtcagaccctgtcaggacacagcatggacatgagggtccccgctcagctcctggggcctcctgctgctctggctcccaggtaccagctgtgacatccaattcgacccagtcctccactccctccctgtctgcatctagttggagacagacgtccaaccatcacgttcggccgggcgagtcaggccatcagcgtatttcctttagccgttggttcgcacgaccgaacggaaaccgnggggaccgaccggccccctacgacgtacgtacggtacgtcgtaggtggtacgctactaccgaagtagtcggacggtaggggtcggtaccctacgtccgtaggtcgaggtcggacgtagtcgactacgtcggtagggactagtacttacacctctactactagtacgacgcacgtcctagcgtacgtaccgtagtaacgtttntttaacgtactttaaacttttacttacgtacgttaactaacgttaagttacttacgttacccgtaccggttacggtcggtaccgtcggacggtagggacgtaggtacggaactacgaccgtatggacgtctcgac

SEQ ID NO: 215263 - DNA, 901 bp, Homo sapiens
  misc_feature: GYAE6OF01E47U1.1.34.D01.1.454.CMB.1.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggctcctgctgctctggctcccaggtaccagctgtgacataccaattcgacccagtcctccactccctccctgtctgctatctattggacgacagtacgtccaccactcacgttcggccgggcgacgtcgaggccagtcgacgacgatttcgttacgccgttggttgccagacaacgaaacccggngggaccaccgacccctnacgtacgtcgtagtcgtagtcggtcgactactaccgtagtacgttcggacggtaacggggtccgggttacccctacgttaccggtacggttcggtaacggtccggtaacgtcggtacgtaccgttacgtaccgggtacgggaactaacgtttaaccttaacccgttacctttacccgtaaccctttaacgtaccggttaaccgtacggtaacccggtccggttacccggtcgtaaccccgggtaccgtttaaccggttaaagggttttaacgtttttaaccgttttaacgttaaaccgttttttaacgtttttaaaccgttaccgtttaaccgggtaaactttaaaaccggttttaacggtttaaaccgtttaacccggttttaaacccccggttaacccggttaccgggttttaaccggggggttaacccccggttaacccggggtaaaccccgggggtaaacccgggggttaaacggggttaaacccggggttaaccgggaaaacccgggtttaaaccccgggttaaaccggtacccgggtttaagggtcccgggttacccgtaaccgttaaacccccgg

SEQ ID NO: 215264 - DNA, 921 bp, Homo sapiens
  misc_feature: GYAE6OF01BNNFH.1.34.D01.1.454.CMB.1.raw
  modified_base (151)..(151): a, c, t, g, unknown or other
  misc_feature (151)..(151): n is a, c, g, or t
  modified_base (155)..(155): a, c, t, g, unknown or other
  misc_feature (155)..(155): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagacgagtgcgtcacgaccggtgctcgatttagatcgtctgtgttgggtttgggggagtcagaccctgtcaggacacagcatggacatgacgggtccccgctcacgctccgtgggctcctgctgctctggcctccaggtaccagctgtnaacncttaccgaattcgaccctagtcctcctacttcccgtccctgtccgtnctattacttgtaggaacacgagtaccgtcaaccgnttcgacgttcggccgggactagtccgaaggccatcgacgtacgttacttacgtttcgtaccgttggtcgacgacgacgaaacgaaccggaggggacctaccgcccctacgagtacgttcggtacttcgtagtcggacgtactacctcgtaacggtcgttaacggacggtaccgggggtacggtacccctagttacccggtaggtttcgagggtcggacgtacgtcggtaactggtacggtaggaacgttaacgttcgttaaacctccgttaccgttaaccctaccgtttacgaccgtaaccgtaccggttaaccggtccggttaaccgtacgtaaacccccggggttatttaaccggggtttaaaacgtttttaaccggttaaaccttttaaacggtttttaccgtttttaaaacccgggttttaaccttaaccgtttaaaacggtttaacccgtttttaaagggttaaaacccctttttaaccgttttaaaaaccccccggggttacccgtttaaccgggggtaaccgggtttaacccccggggttaccgggggtaaaccccgggttaaacccggggggtaaccccggggttaaaaagggggtaaccctttaaaacccggggtacccgaaaaccggtttaccggggtaaccggttttccggaaaccggttcgtaaaacccccg

SEQ ID NO: 215265 - DNA, 1024 bp, Homo sapiens
  misc_feature: GYAE6OF01B8P7M.1.34.D01.1.454.CMB.1.raw
tcagacgagtgcgtcacgaccggtgctcgatttagatcgtctgtgttgggtttgggggagtcagaccctgtcaggacacagcatggacatgagggtcccccgctcagctccgtggggctcctgctgctctggctcccgaggtaccagctgtgacatccaattcgaccctagtcctccactccctccctgtctcgctagttctagttaggagactaaggacgtaccaacctatacctaccgttcgggcccggggacgacggttccgacgggacctagtaccgaggtacgttaacgttttacgtttacggtcccggttgggttcgccgaacggaccgaaaccggaaacccggacggggaccgtacccgacccccgtacgaacggtacgttaccggtacggtttctaggttcgggtaccgtacgtaacgttaccgaaggttattacggggggggaaccttaaaccggggggtcccgggttaacccctaaccggttacccggttacgggtttaccggtaagggtccgggacgtacgggttacgtaaaccgtcggttacgggttaaacgggggtaaccttaacgggtttaaacgtttaacccccgttaacccgtttaccgtaaccctttaaaccgttaacgtaacccggtaaccgtaccgggaaccgttccccggttaaggtaaccccgtaacccgggttacccgtttaaagggttaaacgtttttacggttttaaacccgttaacgttttttaaaacccgtttttaagtttttaacccccggttgtttaaaaacccgttaaacgttttaaacggttttaaaccgtttaaccggtttaaccccccggggttaaacccccggtttaggggttttaaccccggggtaacccgggtttaacccggggaaacccggggttaaacggggtaaaccccggtaagggggtttaaacccggggaaaaccccggttaaccgggtaaaaccccggtaaccgggtttaggggtacccggttagggaaccctaaaccccgg

SEQ ID NO: 215266 - DNA, 867 bp, Homo sapiens
  misc_feature: GYAE6OF01CQ3BC.1.34.D01.1.454.CMB.1.raw
tcagacgagtgcgtcacgaccggtgctcgatttagatcgtctgtggttggggtttgggggagtcagaccctgtcaggacacagcatggacatgagggtccccgctcagctccgtgggctcctgctgctcgtggctcccgaggtaccaggctgtgacatccaattcgacccagtctccactccctcctgtctcgcattctagttggagacagagtacaccatcacgttcggaccgggcgagtcgacggccatcgagcgtacttcgtttacgcgttggttgaccagacaacggaaaccgtacgggacgaccgcccctacgacgtactcggtagtactagtggcgacactccagtagtacggacggtaacgggtccggggtaccctacgtaccggtacggttacgaggttacggacgtaacggtcgacgtacggttacggtacgggaacgtacgttaaaccgtttaccgtaaccctttaccgttacctaaccgttaacgtacccgaacggtaccggacccggtcccgtacggtacccgaacgggttacccttaaggggtaaaacgttttacgtttttaacggtaacttttaaaacgtttttaacgtttaaccggtttaaccggtaaccttaaaacgtttaacggttttaaaccgtttaaccgtttaaacccggtttaacccccggtttaaacggggttcccggggttttaaacccgggtaaaccccggggggttaaccccggggttaaaacggggggtaaaaccccggttaaagggggtttaaacggggaaaaccccgttaacccgggttaaaacccgggttaacgggtttcgggggtttaaacccggaccggtttccccgggaaacccg

SEQ ID NO: 215267 - DNA, 604 bp, Homo sapiens
  misc_feature: GYAE6OF01BA42W.1.34.D01.1.454.CMB.1.raw
  modified_base (284)..(284): a, c, t, g, unknown or other
  misc_feature (284)..(284): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattcttagcctggttgcagcaagaaaccaggggcgacgcccctnagatcgtagtctagtgtgcatccatatgacgtaagggtcggtcccatccgtaggttcaggtggcagtcgctagtcgtcgggacagtacttacgacttcgtactacgtatacacgacacgcctgacgngaccctagtaacgtacttttgaacttaattttaattacgtacttaacgaataacgttaattacgttacgttaacccccgttaaggttaccggtaaccggtttaccgggccgggtaaaggggtacccgtaaagggttacgggtaaaccgtaacgtaaaccggtaacggtaccggtagggtccgtggtaaccccg

SEQ ID NO: 215268 - DNA, 806 bp, Homo sapiens
  misc_feature: GYAE6OF01BTLK1.1.34.D01.1.454.CMB.1.raw
  modified_base (272)..(272): a, c, t, g, unknown or other
  misc_feature (272)..(272): n is a, c, g, or t
  modified_base (543)..(543): a, c, t, g, unknown or other
  misc_feature (543)..(543): n is a, c, g, or t
tcagacgagtgcgtcacgaccggtgctcgatttagatcgtctgtgttgggtttggggagtcagaccctgtcaggacacagcataggaaatggacgggtccccgctcacgcctccgtggggcctcctgctcgcctcgtcggcctacccgacggtaccagcgtgtacgaacaacgtacccgtaattccggaaccctacgttccctacctaccttcccctcccgttgtcctcgactacttcgttagtacggaacgacgaacgacgtacctaaccncgtaccgtacggttccgggaccggacgtacgtaccgacggacctagtcgacgtcgttttaacgtttccgttcggtccgttaggtacgacgacggaaccgaaacggaacccggtcgggaccccgtaacccggtcccgtaaacggacgttaccgtttacggtaacgttttcggaagttcggaacgtacttaccgtaacgtaacggttacgtagggaaccggggttaccgggtaccccggtaacccttacggttaacccggttgttaaccgggngggttaccggtatacgttacgtacgttacgggacggtaagtaacttacgtaacctactactacctaactacgacacaacgtcgaccgtcgacgtcgtagtacgtacgttaacgttacgttataacgtttattacgtacgtacgtaacgtaacgttacttaacgttaccttacccgtacgttaccggtacggtaccggtaaccggaacggtacggtaacggtacggtacgtaccgacgtaacgcgtcgacgctccgtacgtacg

SEQ ID NO: 215269 - DNA, 749 bp, Homo sapiens
  misc_feature: GYAE6OF01CHTMA.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtcctccatccctccctgtctgctattctagtggagacagacgtcaccatcacgttggccgggcgagtcgacggccagtcgagtacgtatttcgttacgccgttggttcgacagacgaacggaaaccggaggggtaccgacgcccctagacgtacgtcgtagtctaggtggtacgcacgtccgagtagttcggacgaacggggttccgggtaccctagttacccgaggtttacgaggttacgggactaggtacgactacggttaccggtacggggaactaacggttaactttaccggtaaccttccgtaccgtaaccttacgtaccgacggtacctcgtacccgtacggacccgtacggtaccgttaagggtaaacgtttattttaacggtaacttttaaagttttacttaacgtacgttaaaccgttaaccgttaagtttaaccctttaccggttaaacccggtttaaccccgttacggggttaccggttaaccgggttaccgggaaccgggtaacggggaacgttaacgggtacggaaacggttacccggaaacggttcgtaggtccggaccgtgtacccg

SEQ ID NO: 215270 - DNA, 816 bp, Homo sapiens
  misc_feature: GYAE6OF01D7X9V.1.34.D01.1.454.CMB.1.raw
tcagacgagtgcgtcacgaccggtgctcgatttagatcgtctgtgttgggtttgggggagtcagaccctgtcaggacacagcatggacatgagggtcccccgctcagctccgtggggcctcctgctgctctggcctcccaggtaccagctgtgacatccaattcgacccagtctccactccctccctgtctgcatctagttggagacgagagtaccaccactctacgttcggcccgggacgagtcacggccatcagtcgtactttcgttacgtccgttggttcgcagacgaacgaaaccgcgggaccgaccgcccctacagtacgttcgtagtctagtggtcacactcgaagtgttacggacggtaacgggtccgggtaccctacgtccggtacggttaccgaagggtcggaccgtaggtacgacgtacgtacggtagggtaacgtagttaaccttaaccgtccctttaccaccgttaacctacgtaccgacgtaccgacccggtccgttggaccctaaccggtcttaacgggttaatttacgtttttaacgactttttaaaacgtttttacgttaacggttaaccgttaaacctaaaaggtttaaccgttttaaacgtttaaacccggtttaaccccggttaaaccccccggttttagggtacccgggtttaaccccgggggtttaccgggaaaccccgggggtaaacgggggttaacccccggtaaaaggggttaacccgggtaaaccgttaaaaccccgggtaaccccggttaaaggtcccggggtttacgtaaccccgggtgtaaacccccg

SEQ ID NO: 215271 - DNA, 717 bp, Homo sapiens
  misc_feature: GYAE6OF01DSU90.1.34.D01.1.454.CMB.1.raw
  modified_base (347)..(347): a, c, t, g, unknown or other
  misc_feature (347)..(347): n is a, c, g, or t
  modified_base (704)..(704): a, c, t, g, unknown or other
  misc_feature (704)..(704): n is a, c, g, or t
tcagacgagtgcgtcacgaccggtgctcgatttagatcgtctgtgttgggtttgggggagtcagaccctgtcaggacacagcatggacatgagggtcccccgctcagctccgtgggctcctgctgctctcggcctcccaggtaccagctgtgacatccaattcgacccagtctccattccctcctgtctgctatactagtggacgacagacgtccaaccagtcctacgttcggaccgggcgagtcgaggccatcgagtctatttacttacgtccgttggttgaccaagaccgaaacgaaaccggaggccgacgtccccgtagagtagtccggtaattacgtagtggnacactactagtatcgacggtaacgggtcggtacctagtccgtaggttacaggtgggtaccaggtcgactaggttaccggagggtaacctaagtacttaacgccgttacctactaaacttctacggtaacgaccaccggtcctaggaccgtacgtaaccgtaggttaaacgttacgttttacgtaacgttaaaacttttacgttaaccttaggttaacctaaacgtttagttaaacgtttaccgttaacgggttaacccccttagggtaccgggttaccgttaccgggaacccgggtaaggggaacccggtaaaggggtaaacggtaacgaaccccggtaaacgtaacgtagggtacncggtcgtaaaccg

SEQ ID NO: 215272 - DNA, 758 bp, Homo sapiens
  misc_feature: GYAE6OF01C25GN.1.34.D01.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
tcagacgagtgcgtcacgaccggtgctcgatttagatcgtctgtgttgggtttgggggagtcagaccctgtcaggacacagcatggacatggacgggtccccgctcagctccgtgggctcctgctgctctggctcccgaggtaccagctgtgacataccaattcgacccagtcctccatccctccctgtctgcatctagtgganacagactcaccatctacgtcggaccggnagtcgacggccatcgagcgtactttcgttacgccgttggtcgaccgagacgaacggaaaccggcgggacccgaccgacccctagaacgtacgttacgtacgttacgtagtacggtcgactacgtacgaggttacgttcggacggtaacggggttccgggtaccctaaggtcccggttaggttacgagggttcggacgtaaggtcgacgtacgttcggagggtaactcgtaacttacgacttccgtacacgttactcgacgtccgtaccgtccgaaggtacccgacgtaccgttaagggtttaaactttccggttttaacgaactttttaaagttttaacccttcgttaaccgtaaaccttaaggttaacgtttaaaccttaccgtaacccggtttaaccccgtaggggttaccggttaacccgggttaccggggaacccgggtaaacggggtacccggtaaaggggttaacccggtaaaccgtaccgtaaaccgggttaacggtggaaccggtccgacgtaacccg

SEQ ID NO: 215273 - DNA, 722 bp, Homo sapiens
  misc_feature: GYAE6OF01CGL7W.1.34.D01.1.454.CMB.1.raw
  modified_base (173)..(173): a, c, t, g, unknown or other
  misc_feature (173)..(173): n is a, c, g, or t
  modified_base (262)..(262): a, c, t, g, unknown or other
  misc_feature (262)..(262): n is a, c, g, or t
  modified_base (533)..(533): a, c, t, g, unknown or other
  misc_feature (533)..(533): n is a, c, g, or t
tcagacgagtgcgtcacgaccggtgctcgattagatcgtctgtgttgggtttgggcatggacatgagggtccccgctcagctcctggggctcctgctgctctggctcccaggtaccagctgtgacatccaattcgacccagtctccatccctccctgtctgcatctagtgganacagagtccacactctacgttcggccgggcgagtccgacggccatcgaggctatttcgtttacgccgttggtgcagacgaagaaaccgngggccgtacgccctacgagactcggtagtcgttacgtggtcgaactcgtaccaagtacgttacggacggtaaacggggttccgggtaccccaacgttccggtacggtttaccgagggtacggtacgtaaggtccggtactaacgttccgggaaggtacctaaacggttactaaccgtactaccttaaccgtaacgttctaacgaccggtcacgttccgtagactaccggtacgtaagtaacgtttagttaccgttaatttaacttttaacnccgttacgtaactaaacggttaactttaacttaaaccgtacccggttaaaccctacggggttaccgggtacgtttaccgggaccggggtaaacggaaccggtgtaacggaacgtacccgaaacgtacgtggtccgtactaccgtctacgtacgttcgtacgttcctacgttcctccccgttccgtcccc

SEQ ID NO: 215274 - DNA, 598 bp, Homo sapiens
  misc_feature: GYAE6OF01CFULV.1.34.D01.1.454.CMB.1.raw
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (565)..(565): a, c, t, g, unknown or other
  misc_feature (565)..(565): n is a, c, g, or t
  modified_base (570)..(598): a, c, t, g, unknown or other
  misc_feature (570)..(598): n is a, c, g, or t
tcagacgagtgcgtcacgaccggtgctcgatttagatcgtctgtgtttgggtttgggagtcaggccatcagcgattctttagcctggttgcagcaagaaaccagggcgagccccctcagatcgtagtctatggtgcatccagattgcgtaagggtcgggtcccagtccgaggttcagtggcagtgcagtcgtgggacagtattacactctactactatcagccagcctgaccgacgtccgtagtaagttacttttgaacttaatttttacgttacttgtacaaactagttaatttacgtaaccgttaccccctaaggttcggtacggttaccggggaccggtaacgggggaaccgttaaaggggtcggtaaaaccgtacccgtaaaccggtaacgtttcggtaggtcctacgacctaccgtnttacccgtntttcccgttactactttacccccttccccctaacccttcccctaccgaccgtcccttaacgtttcccgggtacgtaccgggtacggtccggggtccgttacggggaccggaacgggtcctaccgtaagtcggangtccnnnnnnnnnnnnnnnnnnnnnnnnnnnnn

SEQ ID NO: 215275 - DNA, 874 bp, Homo sapiens
  misc_feature: GYAE6OF01A9H0H.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagccctcgggtcggtcctcgcgtcgtcgtccttcggtcgtccctaccggtaaccgtaccgacgtcgttggacaactacctaaccgttaagtacccgaccgtacttccctacctccttcccctcgtcgttactcaacttcttacgttaggtacggaacgacgtacggtacctaccacgttacgtcgttaacggtccggggaccggtacgtacgtacggaccgtactacgtaggtaccgtacgtttacgtttacgttcggtcggttacggtcgacgacgaaccgaaacgacgggacgtaccgaccctcgtaagtacgtacgttacgtacgttacgtacggtcggactaacgtaccgtaacgtaggtacggtacggaacggggttaccggggtccgtaaccttacggtacgggtaacgttacggtacgggtacggtaccggacgtacggtaccggttaggttacccgggaaacgtaacgttaaccgttaacttaacccgttacgttaccctaccgttaaacgttacgacggaacctaccgggttacctacggaccggtaaccgtacggttaaacggttaaccggttaattttacggtaactttaaacggtttacttttaacggttacgaaccgttaaagtaacgtttaattaccgtaccgttaacccgtacgggttacgttcccggtaaacggtcccggaaacggggttaaggtaacgtaagggtaccctaaggtaacctacgggttacgtcggtacgacccgtgtaaacccg

SEQ ID NO: 215276 - DNA, 749 bp, Homo sapiens
  misc_feature: GYAE6OF01AVLEA.1.34.D01.1.454.CMB.1.raw
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccactccctccctgtctgctatctagttggagacagatcacctatcacgttggccgggcgagtcgaggccatcagtcgtatttcttacgccttggttcgacgagaccaaggaaaccgngggcgaccgccctanagtactcgtagtctagtcgtgacactacagtactcggacggtaacggggttccgggtacccaacgttccggtagggtttacgtacgggcggtaccgaggttcgacgtacggttacggtacgggaactacggttaacttacctaaccgttcctacctaacgttacaccgtacggacccacggttccgtacggacctaacgggtaccttaaggtaacgttttacgtttaccgtaacgttttaaacttttacgttaccgttagtaaaccgttaagttaactttaccgtttaacgttaacccggtacccggttacggttacgggtaccgggtttacccgggaaccggtaacggggttaacgtaacgggtaacggtaaccgtaaccggtaaaccggtaggtccggtcggtacgtccggtacccttactcgttccgttaccgttccttacctaccctttcccgtacccccttccccg

SEQ ID NO: 215277 - DNA, 667 bp, Homo sapiens
  misc_feature: GYAE6OF01ALLMV.1.34.D01.1.454.CMB.1.raw
  modified_base (104)..(104): a, c, t, g, unknown or other
  misc_feature (104)..(104): n is a, c, g, or t
  modified_base (279)..(279): a, c, t, g, unknown or other
  misc_feature (279)..(279): n is a, c, g, or t
  modified_base (485)..(485): a, c, t, g, unknown or other
  misc_feature (485)..(485): n is a, c, g, or t
tcagacgagtgcgtcacgaccggtgctcgatttagatcgtctgtgttggggtttgggggagtcagaccctgtcaggacacagcatggacatgacgggtccccgntcagctcctggggctcctgctgctctggctcccaggtaccagctgtgacatccaattgacccagtctccatcctccctgtctgcatctattggagacgagagtcaccatcacgttcggccgggcgagtcaggccatcagcgtattctttagccgtggtcgcagacaacgaaccgngggaccaccgccccgtagacgtactcgtacgtcgtagtggtacgctactcgagtagttacggacggtacggggtccggtaccctagtaccggtaggttcgacggtcggactaggtcacgtacgtcggacgggtacacgttactacgacttccgtactactacgtacgacgacgacgtccgtacgccgtacgtccgtagtaacgttntttacgaactttaacgtttacttacgtagtaactaaacgttatttaacgttaccgtaacccggttacccgtagggtttaccggtaaccggttccgggaaccgggtacggggtaaccgtacgggtacgggtaaacccgtaccgggaaacccggttagtacgggtccggtcgtcggtaacccgg

SEQ ID NO: 215278 - DNA, 778 bp, Homo sapiens
  misc_feature: GYAE6OF01D27R2.1.34.D01.1.454.CMB.1.raw
  modified_base (555)..(555): a, c, t, g, unknown or other
  misc_feature (555)..(555): n is a, c, g, or t
  modified_base (629)..(629): a, c, t, g, unknown or other
  misc_feature (629)..(629): n is a, c, g, or t
tcagacgagtgcgtcacgaccggtgctcgatttagatcgtctgtgttgggtttgggcatggacatgagggtccccgctcagctccgtgggggctcctgctgctctggctcccaggtaccagctgtcgacatccaattcgaccctagtcctccactccctcctgtctgcattctagtcggagtacagtacgtccaacctactccgtaaccgttcgggcccggggtacgtacggtccgaacgggacctagtaccgaaggtccgtttaattttcccgttttacggtccggtttgggttacggaccaacggaaccgaaacgggaaaacccggacgggggaccgtacccggtacccccttacgaacggtacgttaccggttaacgttaccgttaggttacgggtcgtactaaccgtacgtaacgttagtaccggtacgggtaacggggttccgggtaaccctagtacccggttaggtacgaggtcggacgtaagtcgtacgtacgtcgggtacggaactaagttaacttaccgacttctactaactacgtacgacggacnccggtactacggaccgttagacgttaggtaacgtttagtttactactttaatttacttacgtctaagaacgttntttaacttaccgtacggtaacccgttgtacggtaccggtacggaccggtagggaacgttaggtaaccggtaaacacccggtaacgaggtcggtaccgtacacggtccaccgtcgttaggttccctattcccgtaacctcccttcccgac

SEQ ID NO: 215279 - DNA, 741 bp, Homo sapiens
  misc_feature: GYAE6OF01D4YJC.1.34.D01.1.454.CMB.1.raw
tcagacgagtgcgtcacgaccggtgctcgatttagatcgtctgtgttgggtttgggggagtcagaccctgtcaggacacagcatggacatggagggtccccgctcagctcctggggctcctgctgctctggctcccaggtaccagctgtgacatccaattcgacccagtctccactccctccctgtctgcatctagtggagacagacgtcaccatcacttcggccgggcgacgtcgacggccatcgacgtcgtatttcgtttacggccgttggttgcagacgaacggaaaccggacgggaccgaccgcccctacgacggtacgttcggttagttcgttaggtgggtcgacctaatccgtaagtacgttacggacggtaacggggtccgggtaccctacgtaccggtaggttcgaggtcgacgtagtcgactacgtcgagggaactacgttacttacgtaccttacctacgacttacacgactaccacggtccctggtaccacggtccgtagttaacggtttatttacgtacgtttaactttacgtttactacggttaaacctacgtttaaactttaacgtttaacgttaccccggtttaacccgttacggggttacccggggttaaccggttacccgggggtaaccgggtaacgggggtaacccggtaagggggttaaccggaaccggttaaaccccgtaaacgggttacgggttacgttccgggtaccgtccgtaacccg

SEQ ID NO: 215280 - DNA, 656 bp, Homo sapiens
  misc_feature: GYAE6OF01B1BKV.1.34.D01.1.454.CMB.1.raw
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccccaggtaccagctgtgacatccaattgacccagtctaccactccctccctgtctgtcatctattggagacagacgtcaccatcacgttgccgggcgagtcgaggccagtcagcgtatttcttagcctggttcgcagacaacgaaacccgagggccgacgccccgtnanagtcgtaagtctaatggtcacatccaaggtattcggccgtaaaggggtcgggtccccaaacgttcccgaaaggttccgtaaggtggacgtaaggtacgcctaaacggtcgaaggggaacctagtaacttaaccacttcctaaccgtaactactacgacgtactacgacctgcgaacgcccgttaaggaacgttattttacgacttaacttttaacgttactacggtaactaaactaacgtttaacttaacgttaaccgtaccccgttaacgggtacgggtaccggttacggccgaacggggtaacaacggggttagaaaccgtacgtaaaccggtacgtaggcgcgtcgtaccg

SEQ ID NO: 215281 - DNA, 625 bp, Homo sapiens
  misc_feature: GYAE6OF01B2DD7.1.34.D01.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (318)..(318): a, c, t, g, unknown or other
  misc_feature (318)..(318): n is a, c, g, or t
  modified_base (378)..(378): a, c, t, g, unknown or other
  misc_feature (378)..(378): n is a, c, g, or t
  modified_base (435)..(435): a, c, t, g, unknown or other
  misc_feature (435)..(435): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattgacccagtctccatcctccctgtctgcatctatgganacagntcaccatcacgttcggccgggcgtagtcaggccaatcagcgtatttctttagccgttggttcacagacaacgaaaccgngggacgacgcccctagagtactcgtatctagtcggtncactcagtatgacggaaggggttccgggcctagtccgtaggttcgaggtcggcgtaggtnacgtagtcgtagggtactaagtacttacacgtctactactactacgacgcgacgtcncgacgacgtaccttaggtaatttactttacgtaactttaagttttaactacgttactaacgtaacgttagttaacttacggtacccttacccggttaggttacgggttaccggtaccgggtaccgggtaacggaacgggtaagggaggaaccgtaacggtaaccgtaggtcggtacggcctaggtacccg

SEQ ID NO: 215282 - DNA, 795 bp, Homo sapiens
  misc_feature: GYAE6OF01BO6ZI.1.34.D01.1.454.CMB.1.raw
  modified_base (205)..(205): a, c, t, g, unknown or other
  misc_feature (205)..(205): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggcctcctgctgctctggctcccaggtaccagctgtgacataccaattcgacccagtcctccatccctccctgtctgctatctagtgganacagagtcaccatccacgttcggccgggacgagtcgaggccatcgagcgtattccgttagccgttggttacgacgagaccgaacggtaaaccggacggggaccgaccgacccccgttagaaggttacgttacggttaacggttaccgttaggtttacgggtcgtaacctacgttaacccgtaagttacgtttacgggaaccgggttaaacggggggtttacccggggtacccctaacgggttaccccggttaacggggtttaccgaggggttaccgggtaacggtacgggttaccggtaaccgttacggttaccgggttaacgggggaaccttaacggtttaacctttaaacccgtaacccttacccgttaacctaacttaccggtaaccgacgtacccgtacgtccctacggaccgtacgtaccgttaaggtaacgttttagtttactaacgttttaatttaacgttactacggtaactaagttacgtttaataccggttaaccgtaccgtagttccggtacgtaccgggcggaacggacggtagggaccgtaacgtaaccgtacggtacgtggtaccgtcgtcgtacc

SEQ ID NO: 215283 - DNA, 608 bp, Homo sapiens
  misc_feature: GYAE6OF01BG1MA.1.34.D01.1.454.CMB.1.raw
  modified_base (116)..(116): a, c, t, g, unknown or other
  misc_feature (116)..(116): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
  modified_base (575)..(576): a, c, t, g, unknown or other
  misc_feature (575)..(576): n is a, c, g, or t
  modified_base (580)..(580): a, c, t, g, unknown or other
  misc_feature (580)..(580): n is a, c, g, or t
  modified_base (582)..(608): a, c, t, g, unknown or other
  misc_feature (582)..(608): n is a, c, g, or t
tcagacgagtgcgtcacgaccggtgctcgatttagatcgtctgtgttgggtttgggagtcaggccatcagcgattctttagcctggttgcagcagaaaccgagggcgacgcccctnagatcgtagtctatgggtgcatccagtattgacgaagggtcgggtcccatccgaggttcaggtggcagtgcatcgtgggacagtattacactctacactatcagcacgcctgaccacgtaccgtagtaagtttagttttagaactttaaattttacgttacgtacgtaactaagtaagttaatttaacgtaaccgtaccccgttaggtacggtaccggttaccggaccgggtaacgggggaacgtaagggtacgtaaccgtaccgaaccggtaagtcggtacggctacgaccccgtaactacgttccgttgttccttaacgtccgttacccttaccccggaattacctaccggtaacggtaacccgtccgtacccggttcgtcggtacgggacgggtccgggtacggtccggaaggaaccgggtcgaagtacgtagngacgtananncngcgctacncnngagnannnnnnnnnnnnnnnnnnnnnnnnnnn

SEQ ID NO: 215284 - DNA, 727 bp, Homo sapiens
  misc_feature: GYAE6OF01BBLEO.1.34.D01.1.454.CMB.1.raw
  modified_base (102)..(102): a, c, t, g, unknown or other
  misc_feature (102)..(102): n is a, c, g, or t
  modified_base (126)..(126): a, c, t, g, unknown or other
  misc_feature (126)..(126): n is a, c, g, or t
  modified_base (282)..(282): a, c, t, g, unknown or other
  misc_feature (282)..(282): n is a, c, g, or t
  modified_base (682)..(682): a, c, t, g, unknown or other
  misc_feature (682)..(682): n is a, c, g, or t
tcagacgagtgcgtcacgaccggtgctcgatttagatcgtctgtgttgggtttgggggagtcagaccctgtcaggacacagcatggacatgagggtccccgntcagctctggggctcctgctgctntggctcccaggtaccagctgtagacactccaattcgacccagtctccatccctcctgtctgctattctagttcggagaccagacgtccaccgattccacgttggacccgggcgacggtcacggccatcgacgtcgtatttcttacggcctgggttncagcaacggaaccgtcgggccaccgcccctagtagctacgtgttctagtggttcacgtactaccgtagtcgttacggacggtaacggggttccggtacctacgtccggtaggttcgaaggtggactaggtcgtacgtaacgttcggtacgggtaactacgttaaccgttaacctaccgttacttaaccgtacgttaccgtacgtacggacctaccggtccggttaacgacgtacccgtacgttaacgggttaacgtttacgttttaccgtaaacgtttttaacgttttactaccgttaaccgttaacctaaacggttttaacgttaactttaaccggtaaccccggttacccggtagggttaccggttacccggtcgggtaaccggtaacgggttaacgngggtaaccgtacgaccgtaacggtactgggtcgtcctgtaacccg

SEQ ID NO: 215285 - DNA, 524 bp, Homo sapiens
  misc_feature: GYAE6OF01B5Q2U.1.34.D01.1.454.CMB.1.raw
  modified_base (274)..(274): a, c, t, g, unknown or other
  misc_feature (274)..(274): n is a, c, g, or t
  modified_base (484)..(524): a, c, t, g, unknown or other
  misc_feature (484)..(524): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcgaagggtcgggtcccatccgaggttcagtggcagtgcatcgtgggacagattacactctcactatcagcacgcctgcacgcctagaagttatttgacttaaatttacttactgtacaagtagttaattanaccgttaccctaggtcggtacgttccggaccgaggggaccaagggtcgtaaacgaccgaaaccgtagtggtacggctaggaccaccgtattccttaggtccttagtaccttcccgtaccccgactacgtttccacggaaccctctaaccgtttcgtaacgtcgggaacggtccgggtctacgggacggtaacggcgtaactagtacgcgnnnnnnnnnnnnnnnnnnnnnnnnnnnnnnnnnnnnnnnnn

SEQ ID NO: 215286 - DNA, 564 bp, Homo sapiens
  misc_feature: GYAE6OF01ECBW0.1.34.D01.1.454.CMB.1.raw
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(530): a, c, t, g, unknown or other
  misc_feature (529)..(530): n is a, c, g, or t
  modified_base (533)..(538): a, c, t, g, unknown or other
  misc_feature (533)..(538): n is a, c, g, or t
  modified_base (540)..(564): a, c, t, g, unknown or other
  misc_feature (540)..(564): n is a, c, g, or t
tcagacgagtgcgtcacgaccggtgctcgatttagatcgtctgtgttgggtttgggagtcaggccatcagcgatttctttagcctggttgcagcagaaaccagggcgagcccctcagatcgtagtctatggtgcatccagattgcgaaggtggggtcccatccaggttcagtggcagtgcatctgggacagattacactctcactatcagcagcctgcacgcctgaatattttgacttaattttattactgtactaacgtagttaatttaacgtaccgtaaccccgttaggtaggtaccggttccggaccggaagggggaacccgtaaggggttacgggaaacgtaccgaaacccggacgttgggtcggtacctcgacctaaccctagttccgttcgttcctttactaccgttcccgttaccccggacctataccgttacggaacccgtcctacccgttccggtcgtaggacgggtccggggtctacggggactaacgggcctaactagtaggcactgacnagtncngnntannnnnngnnnnnnnnnnnnnnnnnnnnnnnnn

SEQ ID NO: 215287 - DNA, 1199 bp, Homo sapiens
  misc_feature: GYAE6OF01C8WGM.1.34.D01.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccgaggtaccagctgtgacatccaattcgacccagtcctccactcctccctgtctgcatctagtgganacagatccacatcacgttcggccggngtacgtcgacggccatcgagtcgtactttcgttacgtccgttggttcgactagaccgaaacggaaaccggcgggtaccgaccgtaccccccgtagtaacggtacgttaccggttacgttacggtacggttcgggtacgacctaaccgttacccggtaaaggtttaaccggttaccgggtaaaccgggttaaaccggggggtttccccggggtttaacccccgtaaccggttttaccccggggttaacgggttttaaccggtaacggggttacccggggtaccggtttaaggggtacccgttaacccggttaacggtttaaccccggggttaacgggggtaaaacccggtttaaaacgggttttaaaccccgttttaaaccccccttaacccccggttttaaaccccgggttttaaacccccttaaaaacccccggttttaaaccccgttttaaaccccggggtttaaaaaacccccggggaaaccccccccggggtttttaacccccggggttaaaccccccccccggggtttaaaccccgggggttaaaaccccccgggttttaaaacccccggggggtttaaaaccccccccggggttttttaaaaacggggggtttttttaaaaaaccccggggttttttttaaacccccggggtttttttttttaaaacccccgggttttaaaaaacccgggtttttttttttaaaaaaaccccgttttttttttaaaccccggggttttttttaaaacccccccgggttttaaaaaacccggggtttttaaaacccccgtttttaaaaaaaaccggggtttttaaaacccccgggttttttttttaaaaaaaacccccgggtttttttaaacccccccggggttttttaaaaaaccccccccggggggtttttttttaaaaaccccccccccccgggggttttaaacccggggggggggttttttaaaaaccccccc

SEQ ID NO: 215288 - DNA, 657 bp, Homo sapiens
  misc_feature: GYAE6OF01BSVBW.1.34.D01.1.454.CMB.1.raw
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccggcgagtcaggccatcagcgtattcgttagccttggttcgcagacaacggaaaccgagggccgaccgcccctagagtacgtcgtagtctagtgggtcnctataccgagtacttggaccgtaaggggtccgggtacctacgtcccgtagggttcacgggtcggcgtaggtcgactagtcggtagggaactaagtaacttaccacttctactacttatcgacgcaacggccttaggaccgagtacctaggtaacgtttacttttagaactttaattttacttaccgtacgttaacaaagtttacgttaattaaccgttaaccgttaaccccggttaggttaccgggttacccggtccgggacccggtaagggggtaaccctaaggggtaccggtaaacgtacccgtaaaccggtagttcgggacgtccgtgtaaccccg

SEQ ID NO: 215289 - DNA, 749 bp, Homo sapiens
  misc_feature: GYAE6OF01C0USW.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggcctcctgctgctctcggcctcccaggtaccagctgtgacatcccaattcgacccagtcctcccactccctccctgtctcgctattctagttggagacagacgtccaaccactccgacgttcggccgggacgagtccgacggccatcgagtcgtactttcgtttacgcgttggtgacagaccaacgaaaccgacgggaccgaccgtccccctagaagtacgtacggttagtaccgttagtggtcgacctacgtaccgtaagtcgttacggacggtaacggggttccgggtacctacgttcccggtaggttcgagggtcggacgtaggtcgtacgtacggtcggtaaggaactacgtaactttaacctaccgttacctaccgtaacttactaccgacgaccgtccgtccgacgtaccgtaccgtacgttaacggttaagtttacgtttagtaacttttaatttaaccttacgttacgttaacttaacgttaacttaacttacgttaacccgttacccggttaccggtaccgggttacggtacccgggaaccggtaacggggtaaccggtaacgggtaaccggtaaacgtaccggtaaacccggtaacgttgggtacggtccgttccgggaacc

SEQ ID NO: 215290 - DNA, 759 bp, Homo sapiens
  misc_feature: GYAE6OF01E0HWR.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctccaggtaccagctgtgacatccaattcgaccagtctccactccctcctgtctgcatctagtggagacagagtcaccatcacgttcggccgggcgagtcgacggccagtcacggcgtatttctttacgccgttgggttcgacgacgaccgaacggaaaacccggaggggtaccgaccggccccctacgaagtaacgttccggtaagttccgttaagttggggtcgactaaccgtccgtaagtacgttacggaccggtaacgggggttccggggtacccctagtacccggttaacggttacggtacggtcgggacgtaggttaccgacgtacggtacggtaggggaactaggtaactacgtacctaccgtactaacttacacgacgactaccgtcctaggacctacggtaccttaaggtaacgttttacgttttacgaaccgttttaaagtttttaacgtaccgttacgttaaccttaaacgtttaacgtttaacctttaaccgtacccgttaaccccggttacgggttaaccgggtaccggttcccgggaccgggtaaaggggacccgttaaacggggtaaggaaccgttaaccgaaaccggttacggtggtccggtacgtcgtaaccg

SEQ ID NO: 215291 - DNA, 944 bp, Homo sapiens
  misc_feature: GYAE6OF01CXJHZ.1.34.D01.1.454.CMB.1.raw
  modified_base (103)..(103): a, c, t, g, unknown or other
  misc_feature (103)..(103): n is a, c, g, or t
  modified_base (149)..(149): a, c, t, g, unknown or other
  misc_feature (149)..(149): n is a, c, g, or t
  modified_base (154)..(154): a, c, t, g, unknown or other
  misc_feature (154)..(154): n is a, c, g, or t
tcagacgagtgcgtcacgaccggtgctcgatttagatcgtctgtgttgggtttgggggagtcagaccctgtcaggacacagcatggacatggacgggtccccnctcagctccgtgggctcctgctgctcgtcggcctcccgaggtaccngctgngacatacctaattcgacccagtcctccactccctccctgtcctgactacgttcttagttacgggacaacgaggactaccaaccgtacttaccgtaccggtttcgggaccgggtacgtaacgttaccggaacgggtacccaagttccgaaggtaccggtttaacttttaccggtttacggtcccgttgggttacggacctaacggaaccgaaaaccggaaaaccgggtcggggaccgaacccggtaccccctaaggtaacgtaccgttacggttacggtacgttaggtgggcctaactacttaccgtaaggtagttaccgggaacggttaacgggggtccggtaccctaacgttacccgggtaggttacggacggttcgacgttacggacgtaccgtagttccggaagggaactaacgtaactactaaccttcgtaactactagtacgaaccgtacgtaccgtaccgtacggacgaccgtaaccgttaacgggtaatttttccgggtttaaacgtaaactttttaacgttttaacgtttaacccggtaacgttaaaaccgttaaacgtttaacgttttaaacccggttaaccccggtttaaacccggttaaccccgggtttaacgggggtaccccgggtttaaaccggggtttccggggaaaaaccccggggttaacgggggggtaaaacccctttaaaggggggttacccccgggtaaaacgttaaaccccggtaaaccggggtcggttaaacgggggtttcccgggaaccttccgggtaaaaccccccg

SEQ ID NO: 215292 - DNA, 795 bp, Homo sapiens
  misc_feature: GYAE6OF01C4O8P.1.34.D01.1.454.CMB.1.raw
  modified_base (784)..(784): a, c, t, g, unknown or other
  misc_feature (784)..(784): n is a, c, g, or t
tcagacgagtgcgtcacgaccggtgctcgatttagatcgtctgtgttgggtttgggggagtcagaccctgtcaggacacagcatggacatggacgggtcccccgctcagcctccgtgggctcctgctgctgtcgcctcccgacgtaccagtctgtcacactacctaatccgacccacgtcctcctactccctcctgtctcgctattactagtaggaagacgagtactaccaacctagtaccgtacgtccggccgggacgacgtaccgacggacctactccgacgtacgtttacgtttacgtttacgtccggttaggtcgacgaacgacgaaaaccggaaaccggtcgggacccgtacccggtacccccgtagaacggttaccgttccggttaacgttacgttacggttgggtacacctacgtacgaaagttacggttacggaacggggttaaccggggtaccgggttaacccctaacggtttaccgggtacgggtttaccgacgggttaacggcgttaggtacccgtagtacggtttacgggacggtaaacgttacgtaaccttaccgtaccctttactaaccgtaacttacgtacccgagtaccgtaccgtccgagacccgtacgtacgtaacgttaacgtttattactaactttaactttaacttcgtagtaactaacgtatttaacgttacccgtaacgttaacccggtgtacgggttccgaccgggtaacgggacggtaaggtaacggttacgaacgttaccgtaaccgtgttccggganccgtagtaccg

SEQ ID NO: 215293 - DNA, 578 bp, Homo sapiens
  misc_feature: GYAE6OF01BKQ25.1.34.D01.1.454.CMB.1.raw
  modified_base (203)..(203): a, c, t, g, unknown or other
  misc_feature (203)..(203): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtgggtccatccaggttcagtggcagtgcatcgtggacagattacactctcactntcagcacgcctgccagcctagaacgttattttacgacttaaatttttataccgtagtacaaactagttaattactacgttacccctagtcggtacgttccggaccgaggggaacctaagggtacgaacgtaccgaaacgtactggtacgctgacctacacttctcgttactcacgttcccttccgcccctactcgaccgactaccgttcggacctggtacggccgggtcgttacgggacgtaacgggcgtaccaagttacgngtacgngtcacngtnacgtcgancgatgacgacanatcgtactcacgtacgtcgtacgacgtagtactacgtacgngtacgtganacgagactacgacagagagcgtcgtacg

SEQ ID NO: 215294 - DNA, 748 bp, Homo sapiens
  misc_feature: GYAE6OF01DTNML.1.34.D01.1.454.CMB.1.raw
tcagacgagtgcgtcacgaccggtgctcgatttagatcgtctgtggttggggtttgggggagtcagaccctgtcaggacacagcatggacatgacgggtccccgctcagctccgtgggctcctgctgctctcggctcccgaggtaccagctgtgacatccaattcgacccagtcctcactcctccctgtctgactatctagttggaacgacagacgtccacctatacctacgttcgggcccggggacgtacgtccgacgggtaccattccgacggtaccgttacgttttacgttttacggtccgttgggtttacgacgacggaacgtaaaccggaaaccggacggggtacccgaccgtaccccccgtagaaggtacgttccggttacgttacgtagttcggtacgtacctaacgttaccgaaggttagttcggtaaccgggtaagggggttcccgggtaccctacgttaccgtagggttacgtggtacgacgtagtcgtacgtagttacggtacggtaacgtacgttaacttaccgtaccgttacctactaaccgtactacgtacggaccttacggaccgtacggacctacgtacgttaaggtacctttgtttacgtaactttaacgtttactacgttacgttaactaacgttaagtttactacgttacccgtaaccgtacgtcggtccgtacggacggtacggacggtaggtacgaacgtacctacggtacgtggactcgacgtacc

SEQ ID NO: 215295 - DNA, 786 bp, Homo sapiens
  misc_feature: GYAE6OF01C5UNO.1.34.D01.1.454.CMB.1.raw
tcagacgagtgcgtcacgaccggtgctcgatttagatcgtctgtgttgggttggggagtcagaccctgtcaggacacagcatggacatgagggtccccgctcagctcctgggctcctgctgctctggcctcccaggtaccagctgtgacatccaattcgacccagtcctccatccctccctgtctgctatctagtggagacagagtccaacctatcctacgttcggccgggacgtaagtccgacggtccagtccgagtacgttactttccgttttacggccgtttggttcgaccgaagaccgaaacggaaaccggacggggacccgtaccgtacccccgtacgtaaggacttacggttacgtacgtacgtggtcgactacgtaccgagtagttcggacggtacgggtccggtaccagttacccgtaggttccgagggtcgacgtacggtcgtacgtaacgttcggtacgggtaactaggtaaccttaacctccgttaccgttacaaaccgttagtaccaacggtacctaaccggtccgtaacggccgtaacgtacccgtttaaggtaaacgttttacgtttacgtaacgtttaattttaaccgttacgtacgttaacctaacgtttaagttactttaacccgtaacccggttttaaccccgaggggtttacccggtaccgggttacccggaacggggtaaccggggtaaccggttaaaggggtaacccgtaaaccgttaaccgggtaaacccgttacggttcggtaaccggtcctacgggtaaccc

SEQ ID NO: 215296 - DNA, 647 bp, Homo sapiens
  misc_feature: GYAE6OF01CW0CD.1.34.D01.1.454.CMB.1.raw
  modified_base (201)..(201): a, c, t, g, unknown or other
  misc_feature (201)..(201): n is a, c, g, or t
  modified_base (532)..(532): a, c, t, g, unknown or other
  misc_feature (532)..(532): n is a, c, g, or t
  modified_base (545)..(545): a, c, t, g, unknown or other
  misc_feature (545)..(545): n is a, c, g, or t
  modified_base (610)..(610): a, c, t, g, unknown or other
  misc_feature (610)..(610): n is a, c, g, or t
  modified_base (623)..(623): a, c, t, g, unknown or other
  misc_feature (623)..(623): n is a, c, g, or t
  modified_base (638)..(638): a, c, t, g, unknown or other
  misc_feature (638)..(638): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattggcaagggtgggtcccatccgaggttcagtggcagtgcatcgtgggacagatacactcncactatcagcagcctgcagcctgaagtattttgactaaattttattactgtaccgaactagttacttactacgttacccccgaggttacggtaccggttccggaccggaagggggtaccctaaggggttacggaaacgttaccaaaacccggtaacgttggtccgggtaccttgacctaaccaagtttccgtagttcccttactacctttcccgttacccccggtactacttaccgttacggaacccgtcctacccgtaacgtccgttacgggacggtaccgggtgtacgggtaaccggtaacgggccggtaacgaacggttaacggccgngtcgacgactacncgtgtacgtcgacgacgtacgtcgtactacgtagtcgtacgacgacgactacgagtcgtacacgngacgagcgacgtnacgtgcgtacgacanagtcgtgtc

SEQ ID NO: 215297 - DNA, 851 bp, Homo sapiens
  misc_feature: GYAE6OF01EJGP7.1.34.D01.1.454.CMB.1.raw
  modified_base (104)..(104): a, c, t, g, unknown or other
  misc_feature (104)..(104): n is a, c, g, or t
  modified_base (150)..(150): a, c, t, g, unknown or other
  misc_feature (150)..(150): n is a, c, g, or t
  modified_base (157)..(157): a, c, t, g, unknown or other
  misc_feature (157)..(157): n is a, c, g, or t
  modified_base (206)..(206): a, c, t, g, unknown or other
  misc_feature (206)..(206): n is a, c, g, or t
tcagacgagtgcgtcacgaccggtgctcgatttagatcgtctgtgttgggtttgggggagtcagaccctgtcaggacacagcatggacatgacgggtcccccgntcagctccgtggggcctcctgctgctcgtcggcctcccaggtaccngctggtnacataccgtaattcgacccctagttcctaccacttccctcccttgtctnctatctagttggatacgagacgtccaacctactccgtacgttcgggcccggggacgtacggtccgaacggtccaagttccgaaggtcgttaacgttttccgtttaccggtcccggttggttcgacgaacggaaccgaaaccgggaaaaccggacggggaccccgtacccggtcccccgtacgaacggttacgttaccggttaacgttcgttacggtcgggttacacctacgtaccggtaagttacgttcgggtacgggtaaccggggttccggttacctacgtacggtacggtttcgacggtcggacgtaggtacgcttaacggtcgtaacggtaacgtacgtaacttaccctacctttacgtaccctaagttacctacgaccgtcgtacgtccgtagtaccgtacgttaaggtaaccttttgttacgtttaaccttaagttttaccgttacggttaactaaccgttaactttaaacgttttaaccttaaccgggtaacccgtttacccggttacggggtttaaccgggtacccccggtaccgggtaaccgggaaccgggggttaaaccgtaaaggggttccggtaaaacccttaccggaaccggtttaaccggtggtaaccgggaccttaccggaacttacccg

SEQ ID NO: 215298 - DNA, 471 bp, Homo sapiens
  misc_feature: GYAE6OF01CGLAT.1.34.D01.1.454.CMB.1.raw
  modified_base (231)..(231): a, c, t, g, unknown or other
  misc_feature (231)..(231): n is a, c, g, or t
  modified_base (428)..(428): a, c, t, g, unknown or other
  misc_feature (428)..(428): n is a, c, g, or t
  modified_base (432)..(433): a, c, t, g, unknown or other
  misc_feature (432)..(433): n is a, c, g, or t
  modified_base (437)..(437): a, c, t, g, unknown or other
  misc_feature (437)..(437): n is a, c, g, or t
  modified_base (439)..(471): a, c, t, g, unknown or other
  misc_feature (439)..(471): n is a, c, g, or t
tcagacgagtgcgtcacgaccggtgctcgatttagatcgtctgtgttgggtttgggagtcaggccatcagcgattctttagcctggttgcagcagaaaccaggggcgagcccctcagatcgtagtctatggtgcatccagattgcaagggtggggtcccatccaggttcagtggcagtgcatcgtgggacagacttacactctcatatcagcagcctgacagcctgaagtnttttgactaattttatactgtacaactagtattactacgtacccctaggtggtaccgttccggccgaggggaccaaggtacggaactccgaaccgatggtagctgccaccatcgtgtcctcacttccttcccgctactcgtacgaactctacgtcgtcgtcggacgggcggtcgtggacgaacgggctacgtagtancgannagcngnnnnnnnnnnnnnnnnnnnnnnnnnnnnnnnnn

SEQ ID NO: 215299 - DNA, 735 bp, Homo sapiens
  misc_feature: GYAE6OF01A526K.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctcctgtctgcatctagtggagacagagtcacatcacgttggccgggcgagtcaggccatcagcgtatttctttacgccgttggttcgcagacgaacgaaaccggtagggccggacgccccctagacgtagtccgttagtcttagtggtcgactactccgagtattcgacgtaggggtcgggtccagtccgtaggttactaggtcggcgtaggtcgacgtacgtcggtagggaacctaggtacttaaccgacttacgttacaacgttactacgacgccgtaacgcccttaggaccgaccggtaccgttaagggttaaacgtttacgtttttaacggaactttttaaaacgttttaaccgtttacgttaaccggttaaaccttaaacgttaactttaacgttttaaaccttaaacccccgggtttaacccgttaaaccgggttcggggtaacccggtttaccccggggaaccggtaacgggggtaaccggttaaaggggtacggtaaaccgtaaccggtaaacccggtaacgttacggggtactccgtaacggtaacccg

SEQ ID NO: 215300 - DNA, 790 bp, Homo sapiens
  misc_feature: GYAE6OF01C2ULP.1.34.D01.1.454.CMB.1.raw
  modified_base (103)..(103): a, c, t, g, unknown or other
  misc_feature (103)..(103): n is a, c, g, or t
  modified_base (145)..(145): a, c, t, g, unknown or other
  misc_feature (145)..(145): n is a, c, g, or t
tcagacgagtgcgtcacgaccggtgctcgatttagatcgtctgtgttgggtttgggggagtcagaccctgtcaggacacagcatggacatgacgggtccccgntcagctccgtgggctcctgctgctctggcctcccaggtaccngctgtgacatccaaattcgaacccagtcctccactccctccctgtctgcagttctagttgggacacagacgtccaacctatccaacgttcggccgggacgtaagtcgacggccatcgagtccgtatttcgtttacgccgttggtgacagaccgaacggaaaccgaggggccgtaccggccccctacgacgtacgttaccggtaacgtccgttagtcgggtcgacctagtacccgagtagttacggacgtaacgggttcgggacccctaagtcccgtaaggtttccgaaggtcggacgaggttcgacgtacgttacgtagggaaccgtagtactttaccaccgttcttacctaacgtactcgaacggtcaaccggccttaccgactaccggtaccgttaggtaaacgtttattttacgaacttttaagtttttaacctaacgtttaggtaaccctaaagttaacgtttaacctttaccttaaaccccggttaaccccgttacgggttacccgggtttacccggtaaccggggtaacccggtaaaccggggggttaacccggtaaaaggggttaccggtaaaaccccgttaccgtaaaacccccggttaacggtcggggtttaacgcccgttaacccggtaacccgg

SEQ ID NO: 215301 - DNA, 811 bp, Homo sapiens
  misc_feature: GYAE6OF01D8XMV.1.34.D01.1.454.CMB.1.raw
tcagacgagtgcgtcacgaccggtgctcgatttagatcgtctgtgttgggtttgggcatggacatgagggtccccgctcagctccgtggggctcctgctgctctggcctcccaggtaccagctgtgacactaccaaattcgaccctacgtcctccacttccctccctgtctgactattcgttagttgggaacgacaggtactaccaacctatcctacgttcgggcccgggacgtagtcgacggccaatcgagtacgttattttccgtttacgccgttggttgacgtagaccgaaacggaaaccggacgggccgaccgtccccctagaacgttacgttacggttacgtacgttaggtcgggtacgactaccgtaccgtaaggttacgttcgggaacggtacgggggttcccgggtaccctaaggttacccggtaaggttcgtacgggtcggacgtaggtcgacttagtacggtacgggaataacggttaacttaccgtaccttacgtactaacttactaccgaagtaccgacgtacccgttacggacgtacggtacgtaaggttaagtttaactttagtaccgttttaaatttcgttaccttacgtaactaacgttaacgtttaactaccgttacccgttaacccggttacgggtacggttacccgggtacggaaccgggtaaccgggtaacggaggtaaccgtaaccggtaaccgtaaacggtacggttacggacggtacgttcgtaaccctacgttacgttacgttccgttaccttccgttaaccctttcccccgtacccccgttccccg

SEQ ID NO: 215302 - DNA, 762 bp, Homo sapiens
  misc_feature: GYAE6OF01C0X4C.1.34.D01.1.454.CMB.1.raw
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtcccccgctcagctccgtggggctcctgctgctctggctcccaggtaccagctgtgacatccaattcgacccagtcctccatcctccctgtctgcatctagttggagacagagtcaccatctacgttcggccgggcagtcaggtccatcagcgtattctttacgcttggttgcagcaacgaaaccgagggccgacgccccgtnagtactcgtatctagtggtgctagtaccagtattacggacgtaacggggtcggtacccacgttcccggtaggttcgagttcgggctaggtcgacgtacgtcggtacgggaaccgtaagttacttaacctacttacgtaacctaactactacgacgtacctacgtaccctgaccgtcggtaccgttaaggttaaacgttcgtttttaacgaacttttaaacgtttttaacgtttaaccgttacgtaaaccgtttaaacttaacggttttaaacgtttaaccgttaaaccccgggtttaacccccgtttaagggggtacccgggtttaacccgggttacccggggaaacccggggttaaacggggttaaaccccggggttaaagggggttaaaccggtaaacccggttaaaccggtaaaaacccggttacggttacggggttacggtccccgtaacggtaaccccg

SEQ ID NO: 215303 - DNA, 608 bp, Homo sapiens
  misc_feature: GYAE6OF01A9S2X.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctccgtggggcctcctgctgctctggctcccaggtaccagctgtgacatccaattcgacccagtctccatcctccctgtctgcatctagttggagacagactcacctatcacgttggccgggcgagtcacggccatcgaagcgtatttctttacgccttggttagccagacaagaaaccgaggggccgacgccccctacgaagtacgtccgtagttctagttggtcgactactccgaagtcttggacgtaaggggtcggtcccagtccgtaggttcaggtcgcagtcactagtcgagggactagacttacactcgtacactactcacgcacgcctagccgacgtcctaggtaaacttggtttacgaactttaatttactactacgttactaacgttacgttattactaccgtacccgttacgtcggtaccggttacggccggtaaggggtaccgtagggtacgaaaccgttaccgaacggtacgtgtacggtcgcgtaccg

SEQ ID NO: 215304 - DNA, 644 bp, Homo sapiens
  misc_feature: GYAE6OF01CF3OB.1.34.D01.1.454.CMB.1.raw
  modified_base (326)..(326): a, c, t, g, unknown or other
  misc_feature (326)..(326): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccactccctcctgtcctgcattctagttggagacagagtccaacctatccacgttcggccgggcgacgtcaggccagtcagcgtatttcttacgccgttggttcgcagcgaacgaaaccgtgggcgacgcccctagagactcgtagtctagtggtncactcagtgttcgacgtaagggtcggtacccagtccgtaggttcaggtcggactaggtcgacgtagtcggtacgggaactaggtaacttacaccgtctactactactcgacgtacacgtccgtagaccgtacgtccgttaaggtaacgttactttttacgaacttttaacttttaagttaccgtacgtactaaacgttactttaacgttaacgtaacccgtacccgttaggtacggttaccggtccggaccggtaacgggtacgtaagggtacggtaaacgtaccgtaaacggtacgtcggaaggtccgtcgtaaccg

SEQ ID NO: 215305 - DNA, 865 bp, Homo sapiens
  misc_feature: GYAE6OF01DLW2V.1.34.D01.1.454.CMB.1.raw
  modified_base (202)..(202): a, c, t, g, unknown or other
  misc_feature (202)..(202): n is a, c, g, or t
  modified_base (362)..(362): a, c, t, g, unknown or other
  misc_feature (362)..(362): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccgaggtaccagctgtgacatccaattcgacccagtctccatccctccctgtcctgcatctatgganacagagtccaccatccacttcggcccggcgagtccgacggccatcgacgcgtatttacctttacggccgttggttagacgagacgtaaacggaaaccggacggggaccgaccggcccccctagaagtaccgttacggttacgttaccgttaggttcgggngtacccacgtaccgtaaggtacgttaggaccggtaacggggtccgggtaccctacgtacccggttaagggttaccgtagggttacggacgtacggtcgtaccgtagttaccggtagggtaaccttaagggtaacctttaacccgtaccccgttactacctaaacgttactacgaacgtaccgaccgtacccgtcgaccttaaccggaccggtttaaggttaacgtttaagttttacccgttaaacgttttaatttttaaccgttaccgttaaccgttaacgttaaacgtttaaacgtttaaccgttttaacccggttaacccggtttaaccccccggtttgggtaaacccggggtttaccccgggttaacccggggtaaacccgggtaaacccggggggttaaaccggtaaacgggggttaaccgggttaaacccggtaaacccggttaaacccgggttaacgggttaccgggttacccgggtaccgttcccggtaaaccccg

SEQ ID NO: 215306 - DNA, 900 bp, Homo sapiens
  misc_feature: GYAE6OF01E5GCR.1.34.D01.1.454.CMB.1.raw
  modified_base (329)..(329): a, c, t, g, unknown or other
  misc_feature (329)..(329): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccaggtaccagctgtgacataccaagttcgaccctagtcctccacttccctccctgtctgctattctagtggacgacagacgtccaacctatctacgttcgggccgggacgacggtcgacggacctagtcgaggtcgttaacttttccgttacggtccgttgggttcgacctaacggacaaacggaaacccggnggggacccgtacccggccccgtacgaagtacgttaccggtacgttctacggtcggtacgtacgtaacctaccgtagtagtacggaacgggtaacggggttcccgggtaacccctacggttaccggttacgggttacggtacgggttacgacgtacggtaccggtacgttacggtaccggggtaaccgaacgttaaccgttaaccgtaaccgtacccgtttaaccgtaaccttaacttaacggtacccgaccggttacggtaccccgtccggtaacgtacccgggtaacgttacggttaaacgtttaaggttttacgtttacgttaaaccgttttaagtttaacccgttaacgttaaccgttaaaccgttaaacgtttaacggtttaacccgtttaaacccggttacccccggttaacccgggttaacggggttaacccggggtttaccccggtaaccggggggtaaacccgggtaaacgggttaaacccgggtaaagggtaacccggtaaaccccgttaaaccgggttaaacccggtacggtcgggtttacccggtcgaacccttaaaccg

SEQ ID NO: 215307 - DNA, 714 bp, Homo sapiens
  misc_feature: GYAE6OF01C8ABS.1.34.D01.1.454.CMB.1.raw
tcagacgagtgcgtcacgaccggtgctcgatttagatcgtctgtgttgggtttgggggagtcagaccctgtcaggacacagcatggacatgacgggtcccccgctcagctccgtggggcctcctgctgctcgtggctcccgaggtaccagctgtgacataccaattcgacccagtcctccactccctccctgtctcgctattctagttaggacgactagacgtcaaccctatccgtacgttcgggcccgggacgacggtccgacggccagtcgacgtacgttacgttttacgtttacggtccgttggttcgaccgagaccgaaacgaaaccggcggtaccgacccgtccccgtacgagtacgtcgtagtacgtaggtggtcacacgtacgagtacgtaggtacggtacggggtccggtacccagttcccggtagttcgaggtcggacgtaggtctacgtacggtcgtacgggaactaacgtaccttaccgtactacgtacctactagccgagaccgacgtccctaggaccctacgacgtttaaggtaactttagttttacgtaagttttaacctttagttaacgtaccttacgaaacttagtttaaccttccgtaaccggttaccctgggtaccggtcggttaccggcgggaaaggtacggtaagggtaccgaaccttacggaaccgttaagtggtacccgtcgacggtaaccc

SEQ ID NO: 215308 - DNA, 779 bp, Homo sapiens
  misc_feature: GYAE6OF01APFV3.1.34.D01.1.454.CMB.1.raw
tcagacgagtgcgtcacgaccggtgctcgatttagatcgtctgtgttggggtttgggggagtcagaccctgtcaggacacagcatggacatggacgggtccccgctcacgctccgtggggctcctgctgctctggctcccaggtaccagctggtgacatccaattcgaccctagtcctccactccctcctgtctgcatctatggacgacagagtcaccatcacgttcggccgggcgacgtcacggccatcgacgcgtactttcgtttacggccgttggttcgacagacaacggaaaccggaggggacccgaccgtccccctacgacggtacgttaccggtacgttaccgttaaggtcgggttcgactaactaccgtaaggtacgttacggaccggtaaacggggggttccggggttaccctaacgttcccggtaagggttacgtaacgggtcgggtacgtacggtacgacgtacgttacgggtacgggtaacctagttaaccgttaactacccttaccgtaacctacgttaactaccgaacgtaccgtaaccggtccctacggaccgtaccggtacgtttaacgggaaacttttacggttttactaaacggtttaaactttttacgttacgtaaccggttaacctaacgttaaggtttaacttaacggtacccgttaccccggtagttaaaccggtcccggttacgggaaccgggtacggggaaaccgttagggtaacggaaacgaccgtaaaccggtatggtcggtaactcggtaacc

SEQ ID NO: 215309 - DNA, 663 bp, Homo sapiens
  misc_feature: GYAE6OF01DSUJE.1.34.D01.1.454.CMB.1.raw
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (490)..(490): a, c, t, g, unknown or other
  misc_feature (490)..(490): n is a, c, g, or t
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccagctgtgacatccaattcgacccagtctccatcctccctgtctgcatctatggagacagagtcaccatcatgcggcagtcaggcatcgagtcgattcttagcctggttncagcaaggaaccngggctacgcccctagagacgttcgtacgtctaagtggtcacactccgaagtacgttacggacgtaaggggtcggtacccagtacccgtaggtttccaaggttcggacgtaagtcgtccgaattccgaggggaacctagaactttaacaccttcctanaacgttaancgaacgttacgaacgtcccgttaggtacccgacgtaccgtaaggtagtttaaccggtttttntaacctttaaagttttacgttaaccgtttacggttaacgtaaaccgttaagtttaaccgtttacgtaacccgtttaaccccgttaacgggttcgtaaccggttacccgggtacggaacgggtacgtaacgggacggtaacgtaccgaaccgtaagttggacgtcgtctacccg

SEQ ID NO: 215310 - DNA, 775 bp, Homo sapiens
  misc_feature: GYAE6OF01CO9EI.1.34.D01.1.454.CMB.1.raw
  modified_base (143)..(143): a, c, t, g, unknown or other
  misc_feature (143)..(143): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccngctgtgacatccaattgacccagtctccatccctccctgtctgcatctagtggacgacagagtccaaccctatccacgttggacccggggcgagtccacggtccatacgagcgtacgtttctttacgtccgttggttcgctaacgaccgtaaacggaaaaccgcggggaccgaccgcccccgtacgagtaccgtaccggtaggttaccgtaggttacgggtacgacctaagttaccgaggtagttaccggaacggttaaccgggggttcccggggtaccctaaggttaccccgtaaggggtttaccgtagggttacggccgttaggccggttaccgtacgttacggtacgggtaacgtagttaaccctttactaccgttacctacctaacttacgacaaccggtacacccggtccgtacgtacggtaccgtacgtaacggtaacgtttacgtttacgtaactttaacgtttaacgttacgtacgtacttaacgttaattaacgttacgtaacccggttaccccgttagggttaccggtccgggtttaccggaccgggtaagggtaaccgggtaaagggttacggtaaacgtaacccgtaaccggtaacggtggtaccggtgtccgtaacccg

SEQ ID NO: 215311 - DNA, 890 bp, Homo sapiens
  misc_feature: GYAE6OF01D9I9G.1.34.D01.1.454.CMB.1.raw
tcagacgagtgcgtcacgaccggtgctcgatttagatcgtctgtgttggggtttgggggagtcagaccctgtcaggacacagcatggacatgacgggtccccgctcagctccgtggggcctcctgctgctcgtcggcctcccgaggtaccagctgtacgactacttaccctaaagttccggaaccccctaggttccctaccctaccttccccttccccgttgttcctcgacctacttcgttaagttagggaacgacgacgtacgtaccaacctacttccgtaccgttccgggcccggggtacgtacgtccgacggacctagtccgaggtacttacgtttccgttacgtccgttggttcgacctacggtaccaacggtaaaccggacggggaccgtacccggtaccccgtagtaacggttacgttacggttacggtaccgttaggtcgggtacaccgtacgttaccgaagttacgttacggacggtaacgggggttcccggtaccctacggttaccccggttagggttaccgacgggttcggtaccgtaggtaccgtacttcggttaaccgggtacgggtaacttaacggtaacctttaaccccgtaccgtttaacccgtaccgttaacgttaactccggaaccgtacgtacccgtccgtagccgtaacgtaccgttaaggttaacgttttctttaacggtaacctttagtttaacgttaccgagtttaaccaaagtttgtttaacctaacccggttaccgtaacccggtttacgggtccgggttaacccgggtaccggtacccggggtaaacgggttaccggttaaagggttaaccggaaccgttaaccccgtaggttaaccgttgggtacccgtccggtctaaacccgg

SEQ ID NO: 215312 - DNA, 608 bp, Homo sapiens
  misc_feature: GYAE6OF01A7S2O.1.34.D01.1.454.CMB.1.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttncagcgaagaaccgngggcacgcccctnagactcgtagtctagtggtnctatcgagtattggacgtaacggggtcgggtaccccagtacccgtaggttaccaggtcggactaggtcgctagtcggtagggactagtacttaccacttctactacttancgancgacgtcctgacagtacctagtaacgtttctttcgtattaaatttagttactacgttaacgaacgttaattaacttaacgtcccgttaacccttagggtaccggtaccggttaccgggaccggttaaggggaaccctaagggtaccggaacgtacccgaaaccggttacgtagggacggtcctggaaccc

SEQ ID NO: 215313 - DNA, 692 bp, Homo sapiens
  misc_feature: GYAE6OF01AH99N.1.34.D01.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (412)..(412): a, c, t, g, unknown or other
  misc_feature (412)..(412): n is a, c, g, or t
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacagtccaattcgacccagtcctcatccctcctgtctgcatctagtggatacagacgtcactanactacgttcggccgggngtacgtccgaaggcccagtccacgcgtactttaccgtttagtccgttagggttgacacggacaacgtaaacgcgggacgacgcccctagacgacgttcgtataccgtgtaggtgacctattaccgagtacgtcgacgtaacggggtcggacctagtacccggaggttccagttggatacggngactagttccgagggtaanaacgtactacgtactctacacttaancgactaccgacgtacctagcgtacgaccgttagactttaacttgttaacttaacgttttaactaggtacttaacgaacttaacggttaactaaccggttacgttaacccccgggttaggttaaacccggacgggttaacggacccgggttaaggggaaccggttaaacgggtaaggttaaacccggttaaccgtaaaccggttaccggtaagttacccggtagtcgttaacccgg

SEQ ID NO: 215314 - DNA, 795 bp, Homo sapiens
  misc_feature: GYAE6OF01A60I6.1.34.D01.1.454.CMB.1.raw
  modified_base (174)..(174): a, c, t, g, unknown or other
  misc_feature (174)..(174): n is a, c, g, or t
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtctccatccctccctgtctgcatctattgganacagagtccacctatcacgttcgccgggcagtcaggccatcagcgtatttccgttagccttggtgcgagacaaggaaaccgngggccgacgtcccctgacgtactcggtaagtcttagtcggtacacctacgtaccgtagtactttcgggaccgtaagggggtccgggttaccccaagtcccgtaagggtttccaagggtcggtactaggttcgacctaacgttccgggtaacgggtaactaacgtaaccttaaccaaccgttccgtactaacgttactacgtacgaccgtaacgtccgttaacggcctaacggtacccgttaaggtaaaacgtttacgttttcggaaaccttttaaaggtttttaacccttacggtacgtttaaaaccgtaagtttaaccgtttaagttaacccgttaacccggtttaacccccggttaaggggttaaccggtaacccgggtttacccggggaacggtaacgggggtaacccgtaagggtaccgtaaaccggtacccgtaaaaaccggtcgttccgggttaccgtacgtacccgtaactacccggtaagtttccgttaacgttcccttaccgaccgttttcccccggtacccgtaacccg

SEQ ID NO: 215315 - DNA, 770 bp, Homo sapiens
  misc_feature: GYAE6OF01A6NJ2.1.34.D01.1.454.CMB.1.raw
  modified_base (104)..(104): a, c, t, g, unknown or other
  misc_feature (104)..(104): n is a, c, g, or t
tcagacgagtgcgtcacgaccggtgctcgatttagatcgtctgtgttgggtttgggggagtcagaccctgtcaggacacagcatggacatggacgggtcccccntcagctccgtggggctcctgctgctctggctcccgaggtaccagtctgtgactactaccaagttcgaccctagtcctccacttccctccctgtcctgctattcttagttaggagacgaggtacgtaccaccgatacgtacgttcgggaccgggacgacgtcgacggccatcgagtcgttactttaccgttacgtccgttgggttcaccgaagaccgaaaccggaaacccggcggggaacccgacccgtccccgtacgaacgtacgttcggttacgttctaggtcggtacactacgtccgagttacggtacggtaccgggtaacggggttcccggtacccctaggttaccccgttaaggttacgaggtcggacgtacggtcgacttaccgggttacggaaccggtaacgttaagttaaccccttaccttaacctccgtaaccttaaacgttcgaaccgaactcccggaaccgtccgtaacgtacccgaacttaccggtaagttactttacggtttaaccaatttttaccgtatttacggaacttaaccttagttaaacgttcgtttaaccctacccggttaccgtaggttcggtacccggtaccgggaacgtaacgggacgtacggtaatcccgaaccgtacgacgggttacgcgtccgacgtaccg

SEQ ID NO: 215316 - DNA, 582 bp, Homo sapiens
  misc_feature: GYAE6OF01B2UVH.1.34.D01.1.454.CMB.1.raw
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
  modified_base (439)..(439): a, c, t, g, unknown or other
  misc_feature (439)..(439): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccccaggtaccagctgtgacatccaattcgacccagtctccatccctccctgtctgcatctatggagacagatccaccatcacgttgccgggcgagtcaggccatcgagcgtattcctttagcccttggttgcagcaagaaaccgagggccgaacgcccctgagtacttcggtagtctaagtggtcncatccagnttcggacaaggggtcggtccagtccgaggttcaggtgcagtcgcatcgaggacagtactcgactctacgtactatacagcacgcctgcacgtccgtagtaacgttgtttacncttaagtttaactactacggttaacaacgttacttaacgttactaaccgtacccgttagtccggtaccggttaccggaccgggtagggaaccgtacgggtacggtaacgtaccgaaccgtaacgtggtacgtcgtccgtaccg

SEQ ID NO: 215317 - DNA, 803 bp, Homo sapiens
  misc_feature: GYAE6OF01BBLVT.1.34.D01.1.454.CMB.1.raw
tcagacgagtgcgtcacgaccggtgctcgatttagatcgtctgtgttgggttggcatggacatgagggtccccgctcagctccgtgggctcctgctgctctggctcccaggtaccagctgtgacatccaattcgaccctagtcctccgatcccttccgtgtcctgtactatctagttggaacgactagacgttaccacctaatcctacgttcggaccgggtcacggtcacggtaccagtacgtacggtcgttactttcgttacggtccgttagggttcgaaccgtaacggaaccgtaaccggtaaaacccggacggggtacccgaccggtacccctacggtaacgtaaccggtttccggttaacggttccgttaacggtcggttacggacctacgttacccgtaggttaacgttcggtaacggttaagggtcccgggtacctacggttccggttaaggttcgaacgttacgggacttaggtacgtactaccggtacggtaacgggtactacgtaaccgttacaccgttacctaccgtaacttcgaacggtcctacggtaacgtccgtaggtaaccgtacgttcggtaaagtacgtttaagttccgtaaattttaccgttaagttacccgtaacgtaacttaacggagttttaacccgttaacgtacccggttaccgtaacggttcggtaacccgggttcggaaccgggtaacgttaccggaagttcggaacgttacccgaacggttgacgttcgacgtactacgactagttccgtacttcgaccttacgttcccgccgttacg

SEQ ID NO: 215318 - DNA, 721 bp, Homo sapiens
  misc_feature: GYAE6OF01AOZXN.1.34.D01.1.454.CMB.1.raw
  modified_base (102)..(102): a, c, t, g, unknown or other
  misc_feature (102)..(102): n is a, c, g, or t
  modified_base (715)..(715): a, c, t, g, unknown or other
  misc_feature (715)..(715): n is a, c, g, or t
tcagacgagtgcgtcacgaccggtgctcgatttagatcgtctgtgttgggtttgggggagtcagaccctgtcaggacacagcatggacatgagggtccccgntcagctccgtggggcctcctgctgctctggctcccaggtacctagctgtgacatccaattcgacccagtcctccagtccctccctgtctgctatctagttgagacagacgtcacatcgacgttggccggcgtaagtcgacggccgatcgaagtcgtactttcgtttagccgtgggttacgcgacgacgaacgtaaaccccggaggggccaaccggtccccctagtacgtaacgttccggttaaggttccgtaggttccgggtactaccgtacgtaccgtaggtaacgttggaccggtaaagggggtcccgggtaacctacgttaccgtacggttacgtaggtacggtcctaggtaccgacgtagtaccgttaacggggactaacggttacgttaacctaccgtttactaaccggtaacttacgtacggtacgtaccgtaacgtcccgaggtacccgtagtcccggtaaaggtttacgtttacgtttcgttaaacgtttacttttaacggttacacggtttaacaaacgtttacgtaactttacgtaccgtacgtacggtcgtaacgtcggaccgtaggacgtcgtaggaaccgtgaccgtaggagtcgtacgntacccg

SEQ ID NO: 215319 - DNA, 512 bp, Homo sapiens
  misc_feature: GYAE6OF01CZYHZ.1.34.D01.1.454.CMB.1.raw
  modified_base (102)..(102): a, c, t, g, unknown or other
  misc_feature (102)..(102): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
  modified_base (467)..(468): a, c, t, g, unknown or other
  misc_feature (467)..(468): n is a, c, g, or t
  modified_base (473)..(473): a, c, t, g, unknown or other
  misc_feature (473)..(473): n is a, c, g, or t
  modified_base (475)..(477): a, c, t, g, unknown or other
  misc_feature (475)..(477): n is a, c, g, or t
  modified_base (480)..(512): a, c, t, g, unknown or other
  misc_feature (480)..(512): n is a, c, g, or t
tcagacgagtgcgtcacgaccggtgctcgatttagatcgtctgtgttggggtttgggagtcaggccatcagcgattctttagcctggttgcagcagaaaccngggcgagcccctcagatcgtagtctatggtgcatccagattgcaagggtcgggtcccatccaggttcagtggcagtgcatcgtgggacagattacactcncactancagcagtcctgcagcctagaagtatttgactaattttatactgtaccaatagttatttaacacgttacccctaggtggtaccgttcggaccgtagggggaaccaaaggggttcgaaacgtaccgaaaccgtacggtggtcggacctcgggacctaccgtattcgttcgtcttacgacttccctcccggactacttcgtacgacgtccacttggcctaggcggccgggtntacgggacacggggtcntaaactggntagnnacgtngnnngtnnnnnnnnnnnnnnnnnnnnnnnnnnnnnnnnn

SEQ ID NO: 215320 - DNA, 811 bp, Homo sapiens
  misc_feature: GYAE6OF01AYRYA.1.34.D01.1.454.CMB.1.raw
  modified_base (208)..(208): a, c, t, g, unknown or other
  misc_feature (208)..(208): n is a, c, g, or t
tcagacgagtgcgtcacgaccggtgctcgatttagatcgtctgtgttgggtttgggggagtcagaccctgtcaggacacagcatggacatgacgggtccccgctcagcctccgtggggctcctgctgctctggctcccaggtaccagcctgtgacatccaattgaccccagtcctccatccctccctgtcctgctattctagttgganacgagagtccacctatcctacgttggcccgggacgtagtccgacggcctatcgaagtccgtacttttcgtttacggtcccgttgggttacgcgtaacggaccgaaacggaaaacccgacggggtccgaacccgggtccccctcgtaaacggtaaccgttacgttaacgttaccttaggtacgggttacgactaccgttacccgaagtacgtttggaccggtaacgggtccggggtaccctacgtacccgtagggttacaggtcggtctaaggtcgacgtagttacggtacgggaacaacggtacttacccgtacctccctaacgtaacgttactaccgacgtacgtaccgtcccgtacgtccgacgtaccgtaggtaacgtttacgttttacgtaacgtttaaccgtttaacttaccgttacgtaacgttaaaccgttagtttaccgtttaacgtaacccggtttaaccccgtacggttaccggtaaccgggttacccgggtaccgggtaacgggtaaccggtaaaccggggttaaaccgggtaacggttaacccggtaacccggttaaaccggttggttaacccggtaccgtccgtaacccg

SEQ ID NO: 215321 - DNA, 854 bp, Homo sapiens
  misc_feature: GYAE6OF01AYRU5.1.34.D01.1.454.CMB.1.raw
  modified_base (138)..(138): a, c, t, g, unknown or other
  misc_feature (138)..(138): n is a, c, g, or t
  modified_base (472)..(472): a, c, t, g, unknown or other
  misc_feature (472)..(472): n is a, c, g, or t
tcagacgagtgcgtcacgaccggtgctcgatttagatcgtctgtgttgggtttggggagtcagaccctgtcaggacacagcatggacatgacgggtcccccgctcagctccgtggggctcctgctgcctcgtcgtccnccgtacgtacgctcgtgacactactaactagtaccgaccgtactcctactcctccctctcgtgtacgactcgttactggtagacgacgtagctaccactacgtacctcgtcgggcggacgtcgtacgaccgtacgtacgtacgaacgtcgttttaccgtttacggttccgtcggttggtacaccggaggaaccgaaaaccggtacgggcccgggtaccaccccccgttcgaacggtaacttaccggttacggtttacttacgtacggggtacggtcacggttaaccctgtaaagtttccccgggaagggttaccgggggtaccgggtttacccncgttaaaccgttcgggttaacggtcttacgggcgtagtaccggttaccgacttacccggtagggacccgtaagttaaccgttaactcccttacgtccgtaacctacgtacgtacgaacgccgtaccgtccggtacgtacgtacccgtaacgtagtttaacgtttactttacggttaaacttttacgtttaaccgttagtacgtaaaaccgttacgtttaacttacgttaaccgttacccggttaaaccggttcgggttaaccggttaccccggtaaccggggtaaccgggtaaccccgggtaagggttaaccggtaaacgggttaacccgtaaacccgggtaaaccgttacggggtactcccggtaaccggtcctaaaccgg

SEQ ID NO: 215322 - DNA, 717 bp, Homo sapiens
  misc_feature: GYAE6OF01C81S8.1.34.D01.1.454.CMB.1.raw
  modified_base (507)..(507): a, c, t, g, unknown or other
  misc_feature (507)..(507): n is a, c, g, or t
  modified_base (518)..(518): a, c, t, g, unknown or other
  misc_feature (518)..(518): n is a, c, g, or t
tcagacgagtgcgtcacgaccggtgctcgatttagatcgtctgtgttgggtttgggggagtcagaccctgtcaggacacagcagtggacagtggacgggtccccgctcagcctccgtggggctcctgctgctctcggcctcccgaggtaccagctgtgactactacccaagttccgaccctagttcctcctacttcccttccctgtctgcctattcgttagtgggaacgacgagacgtaccaacctattccgtacgttcgggcccgggtcgtagtccgacggccctagtccgaagtccgttacgtttcgttacggtccgttgggtcgaccgacggaaccgaacgaaccggacgggtccaaccggtcccctagacgtacgttcgtacgtcgtaggtcggacgcctacgtcgagtagttcgacggtaacggggtccggtacctaacgcggttagtcgtagggcggtacgtagtcgaacgtgtacggtacgactagtactccagtcctanacgtacacganccgtatcgacgtccgtacgtacgtaagtacgtttattaccgtaactttatttaccgtactacgggttaactaacggttcttaacgtaaccgttacccgttacggtacggttacgtcccggtaacgggtccgggaagttaccggaaaggttccgggtaacaaccccggtaagttcggaggacccgttcgtacgtacccgg

SEQ ID NO: 215323 - DNA, 942 bp, Homo sapiens
  misc_feature: GYAE6OF01COTVD.1.34.D01.1.454.CMB.1.raw
  modified_base (182)..(182): a, c, t, g, unknown or other
  misc_feature (182)..(182): n is a, c, g, or t
  modified_base (317)..(317): a, c, t, g, unknown or other
  misc_feature (317)..(317): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacactcctaattcgacccagttcctccactccctcccttgtctgctatctagttgganacgagagtcaacctatacgacgttcggccgggacgtagtcgaacggcctatcgagtcgtattctttacgccgttggtgcagacaacgaaccgaggcgaccgccctagagattcggtacgtacgttagtgggtacnctactaaccgtagttacgttacggaccggtaagggggttcccgggtaccctaaagtccgttaagggttacgacgggttacggcgtaacggttcgtaccgtaacgtttacggggtaaaccggggtaactaaacgggttaaccgtttaacccgttaaccttaaccgttaccgttaaacccgttaagttacccgtaacggaacctaacccgggtttcccgaacgggttacccgtaaccggttaccgttaagggttaaaaccgtttttaagttttaacgtaaaccgttttttaaactttaaccgttttaaccggaaagtttaacccgaaaacgttttaacggttttaaacttttaaccccggttaaaccccggtttaacccccgttaacgggggtttaacccgggtttaaccccggttaccggggtaaacccgggtaaaccggggggtaaacccgttaaagggggtaacccggttaaaccgttaaacccgggtaaaccccggtaagggttaccgggtacccggttacggtaccccggttaaccccggttaatcccgggttttaaccctttccgggtttaaccctttaaaccgcccccccttttaccccgtaacccccccgtttaccccg

SEQ ID NO: 215324 - DNA, 722 bp, Homo sapiens
  misc_feature: GYAE6OF01DVTV5.1.34.D01.1.454.CMB.1.raw
  modified_base (102)..(102): a, c, t, g, unknown or other
  misc_feature (102)..(102): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagtctccatccctccctgtctgcntctagtggagacngacgtcaccntcacgttcggccgggngagtcaggccatcgagcgtatttcttagccttggttcgcagacgaacgaaaccggagggccgacgccccctgaacgtacgtcgtagttcgtaggtcggtcgacctacgtaccgagtagttcggacggtaacgggggttccgggtacccctacgttacccgtaacgggttcgaggtcggcgtaagtgactaggttcggagggtaactacgttaacttaaccgtaccttaccgtactaacgttactacgtaacgtccgacgtccctaggaccgtacgtaacccggttaaggtaacgtttgttttacctaacgtttaaattttacgttaccgtacgttaactaaacgtttagtttaaacttaaccggttaaccgttaaccccgttagggttacccgggtaccggttaccgggacccggggtaagggaacccggttaagggtaaccgggtaagttaaacccggaacggttaacgtcggtacgtacgtccggtaacccg

SEQ ID NO: 215325 - DNA, 656 bp, Homo sapiens
  misc_feature: GYAE6OF01E2UHW.1.34.D01.1.454.CMB.1.raw
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattgacccagtctccatccctccctgtctgcatctagttggagacagagtcaccgatcacttgccgggcagtccaggtccagtcagcgtatttcttagccgttggttgcaggcaacgaaaccgngggcctacgcccctnagngttcgtagtctagtcggtncgtactccgagtattcggacggtaacggtcgggtaccccaatcccggtaggttcaggtcggcgagttcgactagtcgtacgggaacaaggttactaaccgtacttccgtacacctatcccgagccgtacgtccctaggccgtaacaccggttaagtaacgttttacgtttacgaaactttaagttttaacttaaccggtagttaacctaaagtaagtttacgttaaccgttaacccgttacccgtacggttccggtaaccgggttaccgggaccgtaaggggaacccgtaaggggtacgaaagtaccgtaacgtacggaatttcgggcggtccgtacg

SEQ ID NO: 215326 - DNA, 837 bp, Homo sapiens
  misc_feature: GYAE6OF01C651B.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattgacccagtctccatcctcctgtctgcatctagttggagactagagtccaacctatcctacgttcggcccggggacgacgtccgaggaccatcgagcgtactttctttacgccttggttgcgagccaacgaaaccgagggccgacgccccctacgaaggtacgttacgttacgtccttaggttcgggtcgactaacgtacaggtagtttacggacggtaaacgggtcggggtacccctagtacccggtaggttccgaggtcgggacctagggtcgactacgttacggtacgggaaccaggttaacttaaccctacccgttacccttaacctaacctttacgtaccgaacgtacccgtacccgggtccctaacgggtccgtaaccgaccgtttaaggttaaacgtttactttttaccggtaaacgtttttaaactttttacgtttaacggttaccgtaaccgttaaacgtaaggtttttaaaccgtttacgttaacccccgttaaccccggggtttaacggttacccgggggtttaaccgggttaccccgggggtaaaccgggtaaaccccggggggttaaccgggtaaacgggggttaacccgggtaaaaccgggtaaccccgttaaaacccggtaacgggtttacgggtaccgggtcccgttaacggtaaacccccgg

SEQ ID NO: 215327 - DNA, 679 bp, Homo sapiens
  misc_feature: GYAE6OF01ADV7X.1.34.D01.1.454.CMB.1.raw
  modified_base (102)..(102): a, c, t, g, unknown or other
  misc_feature (102)..(102): n is a, c, g, or t
  modified_base (287)..(287): a, c, t, g, unknown or other
  misc_feature (287)..(287): n is a, c, g, or t
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctccgtgctgctcgtggctcccgaggtaccagctgtcgacactccgtaattcgaccctagtcctaccacttccctccctggttcctgctattcgtagttggacgactagtacgtccactacgttacctacgttcgggcccggtacgacggtacgaccggcctagtcgacgntacgttcgttacgccgtggttcgcgagacgaacgaacggcgggtccgaccgtccccgtacgagccgtacgttacgtaccgtaggtcggtctacgtacaccagtagttcggacggaggttccggactacgtcgtagtccgtagcggtagacgtgacgtactgtaggtaccgagtacttccgaacttctacgtacttacgcgtaacncgtaactccgtgccgagtaccgacttaagttgttacgtatttatttacctgtaccgtacaagttacgttattaaccgaaccgttcccgtgttacggttaccccggtggaaccccggttaagggaggtttaacggaaccggtttacgaaacccgtacggacccgtaggtccggtcgtcccgtaaacgg

SEQ ID NO: 215328 - DNA, 841 bp, Homo sapiens
  misc_feature: GYAE6OF01BETBB.1.34.D01.1.454.CMB.1.raw
  modified_base (185)..(185): a, c, t, g, unknown or other
  misc_feature (185)..(185): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattcgacccagtcctccatccctccctgtctgcatctattggagacagatcacntcacgttgccgggcagtcaggccatcagcgtatttcttagccgttggttgcagcaagaaaccgngggaccgacgcccctnaagtatacgtagtacgtagtggtgactagtccgaagtagttcggacggtaacggggttccggggtacccctacgttccgtaacgggtttcgacgggttggaccgtaggtcgactacgtaccgggtaacggaacgtaagttaaccgtttacctaccgttctaacctaacgttaaccgtccgtaacggacctaccggtacccgttaggaccgaaccgggttacccttaagggtttaaacgttttaacggtttttacgtaaaccgttttaaagtttttaaccgtttaaccgttaacggttaaacttaaaccgtttaacgttttaactttaaaccggttaacccggtttaacccccggtttaacgggttaccggggttaacccgggtttaacccggggaaccgggttaaacgggggtaaacccgttaaggggtaacgggtaaaaccgttacccgtaaaaccggtaacggttccgggttacggtaccggttacccgacccgttaaccttaaccggttcccggtttaacgttacccctttaaccctttaccccgttcccccgttacccccgttaaccccccg

SEQ ID NO: 215329 - DNA, 461 bp, Homo sapiens
  misc_feature: GYAE6OF01BI4AE.1.34.D01.1.454.CMB.1.raw
  modified_base (327)..(327): a, c, t, g, unknown or other
  misc_feature (327)..(327): n is a, c, g, or t
  modified_base (425)..(425): a, c, t, g, unknown or other
  misc_feature (425)..(425): n is a, c, g, or t
  modified_base (432)..(461): a, c, t, g, unknown or other
  misc_feature (432)..(461): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattaccactctcactatcagcagcctgcagcctgaagtattttgacttaatttatttactgttacaactagtaattatacgtacccctaggtcggaacgttcggccgaggggaccaagggtcggaagccaacgactgngctgcacatctgttctctactccttcccgcctatctagaccgctacgtccgtcgtgacgggtccgggtcgtacgggcgtaacgggcgtacgagtacgngatcgannnnnnnnnnnnnnnnnnnnnnnnnnnnnn

SEQ ID NO: 215330 - DNA, 655 bp, Homo sapiens
  misc_feature: GYAE6OF01AVU1V.1.34.D01.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattgacccagtctccatcctccctgtctgcatctatgganacagngtacacctatcacgttcggccgggcgagtcaggccatcgagcgtattccttagctggttncagcaagaaccgaggcaccgcccctagngatccgtagtctagtcggtgctataccgaagtcgttacggacggtaacggggtccgggtacccctaacgtaccggtacggtttcgaagggttcggacgtaggttcgacgtacgttcggagggtaacctaggttaaccttacgtacctacctaccgaacgttacaccgacgaccgtaggaccctggacacgtaccgtagtaacgttagtttaccgatttaacgtttataccgtagtaccgtaaattagttaaactacgttaacccgtcccgtaggttaccgggaaccgttaccgggaccgggtaacgggtaaccgtacgggtacgtaaaccgtacccgaacgttaacggcgtaaggcctagtaccc

SEQ ID NO: 215331 - DNA, 717 bp, Homo sapiens
  misc_feature: GYAE6OF01B0IXR.1.34.D01.1.454.CMB.1.raw
  modified_base (291)..(291): a, c, t, g, unknown or other
  misc_feature (291)..(291): n is a, c, g, or t
  modified_base (706)..(706): a, c, t, g, unknown or other
  misc_feature (706)..(706): n is a, c, g, or t
tcagacgagtgcgtcacgaccggtgctcgatttagatcgtctgtggttgggtttgggggagtcagaccctgtcaggacacagcatggacatgacgggtccccgctcagctccgtgggctcctgctgctctggcctcccgaggtaccagtctgtgacactacctaattcgaccctagttcctccacttccctccctgtacctgactattctagttggacgacagactcaccatcgtacgttcgggccggcgtagcgacggctactcgagtcttatttcgttacgcgttggtnaccgaggtaccgaacggaaaccggcgggacccacccgtccctacggtatacgttaccggttattcggtagttcggactacgtacgtacgacgttagtcggacgggtacggggttaccggtacctaacggtcggttacggtagtacgggtcgtacgtcgtacgtagtacgtacgggtacggtaataacggttaccttactacctctaaccgtactagtcgacgaccgttcgaccgcgtaaccgtacgttacgtaagttaatttcgtttaacctaagtttaacttacggtccttaaagtaccgttaagttacttaacgttaccgttacccggtacggtacggttcggaaccccggttcgggaacgggtaaggtaccggtacggacggttaaaccgtacgtacgggttacacgggtcngttacccgtac

SEQ ID NO: 215332 - DNA, 497 bp, Homo sapiens
  misc_feature: GYAE6OF01BXR22.1.34.D01.1.454.CMB.1.raw
  modified_base (491)..(491): a, c, t, g, unknown or other
  misc_feature (491)..(491): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcagtcaggccatcagcgattctttagcctggttgcagcagaaaccagggcgagcccctcagatcgtagtctatggtgcatccaagattgcaaaggtggggtcccatccaggttcagtggcagtgcatctgggacagattacactctcactatcagcagcctgcagcctgaatattttgacaattttatactgtcaacagtattatagtaccctagtggacgttcggcgaaggggacaaaggtaggaaagtagaaacccgaactagtcggngtgacg

SEQ ID NO: 215333 - DNA, 912 bp, Homo sapiens
  misc_feature: GYAE6OF01CK4J3.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccgaggtaccagctgtcgacataccaattcgacccagtcctccactcctcctgtctgctatctagttggagacagtacgtaccacctatccgtacgttcggccgggacgtaagtccgaggccatcgagtcgtatttcgttacgtccgttggttcgacgtacggaccgaaacggaaaacccggcggggacccgaccgcccccgtagaacgtacgttacggtagttactaggttcgggtcactacgtaccgacgtagttcggaacggtacgggggttccggtaccctaacgttccgggtaacgttcgtaggtcggacgtaggtcgtactacggttacggtacgggtaactaaggttaaccttacccgtaccttaccgttacctaaccgttaacgtaccggaacgtaccggtaaccggttcccgtaacggtacccgtaaccggtttaacccggttaaggtttaaacggttttaaccgttttaacggttaacctttttaaaccgtttttaaccgtttacggtttaaacccggttaaacggttaaaaccgttttaaacggttttaaacccgttttaacccgggttaaaacccccggtttttaaccccggttaaccggggggtttaacccgggtttaaaccccgggggtttacccggggaaccccggggtaaacgggggttaaaccggtaaaccgggggtttaaccggtaaaacccggttaacccggtaaaaccccgggttacggttaccgggttaccgggtacgttaccccggtaaacccgg

SEQ ID NO: 215334 - DNA, 740 bp, Homo sapiens
  misc_feature: GYAE6OF01BRZ9M.1.34.D01.1.454.CMB.1.raw
  modified_base (102)..(102): a, c, t, g, unknown or other
  misc_feature (102)..(102): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacataccaattcgacccagtctccatcctccctgtctgcatctagtggagacagacgtcaaccatccgtacgttcggccgggtcgacgtcgacggtccatcgacggtcgtaattttaccgtttacggtcccgttagggtttcgcgtaacggacctaaacgggaaaacccggacggggacccgaaccgtccccccgttagaacggttaacgttaccgggttaacggttccttaaggttcgggttagtccctaacgttacctaaaggtacggtttacggaccggtaaacgggggttccgggtacccctaaggtcccggttaagggtttcaaacggggttcggacgtaggtcgacgtacggttcggtacgggacttaagtaaccttaccncttacgtactaacttnacgaacgtcacgctacgcacgtcaagtacgttatttacgatttaacttagttacgagttaacctaagttacgttaacgttacgttaaccgttacccgtaggttaccgggtaccggttaccggaccgggtaacgggtacggaagggtaacgtaccggtaacgaaccgttacggtgtcggtcgtgaaccg

SEQ ID NO: 215335 - DNA, 732 bp, Homo sapiens
  misc_feature: GYAE6OF01BAT2O.1.34.D01.1.454.CMB.1.raw
  modified_base (189)..(189): a, c, t, g, unknown or other
  misc_feature (189)..(189): n is a, c, g, or t
  modified_base (721)..(721): a, c, t, g, unknown or other
  misc_feature (721)..(721): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctcgtggcctcccaggtaccagctgtcgaccacccaattcgacccagtctccactcctccctntctgcatctagttggagacagacgtcacctatcctacgttcggaccgggcgtacgtccgacggccatcgagtacgtatttcctttacggtccgttggttcgacgagaccgaaacggaaaccgaacggggccgacccgcccctacgaacggtacgttacggtacgttcgttagtcggtcgctaccgccgtagtacgttaggaccggtaacgggttccggggtacctacgttaccggtaacggttcgacggtcggaccgtaggtacgtacgtacgttaccgggtacggggaacgttaaggttaaccttaaccgtccctttacctaccgttaaccttactaccgacgtaccgaccggtccctaggacctacggtacccgtaagtaagtttacgttttacgtactttaaagttttactacttagacttaagtatttacgttactaccggttaacccgtggttaccggacggttcccggggaacgtacgggtacgtaaggggtacgaacgtaacccgtaacgtacgttcgaggtacncggactacccg

SEQ ID NO: 215336 - DNA, 740 bp, Homo sapiens
  misc_feature: GYAE6OF01CWP6S.1.34.D01.1.454.CMB.1.raw
  modified_base (727)..(727): a, c, t, g, unknown or other
  misc_feature (727)..(727): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggcctcctgctgctctggcctacccgaggtaccagctgtagacatacctaagttcgacccagtcctccattccctccctgtctgcatctagtgagacagtacgtcaacctatccgtacgtcggaccgggacgtacgtccgaagcccagtccgtaggtccgttacgttaccgtttaggtcccgttagggttcacgaacggaccgaaacgaaaaccggcggggaccgaccgaccccgagacgtacgtacgtagttctacggttggtacgactaactacggagtacgttaccggtacggtacggggttccggtacccctacgttacggttacggttcaagggttcggactgcgtacgacgttcggaggtaaccagttaacttacccgactcgttacctacgtactcgactacgaccggtacgctaccggactattaacgggtaacttagttttaacgactttaaactttacgttacgtaacttaaccgttactaagttaaccgtttactaacccggttcggtaacgggtcggttaaccggtaccgggaacgggtaacggggtaaacgttaggggtaacgaaacccggttactaaaccggtcgtaggttaccgngtaacccgttaac

SEQ ID NO: 215337 - DNA, 892 bp, Homo sapiens
  misc_feature: GYAE6OF01EM3SS.1.34.D01.1.454.CMB.1.raw
tcagacgagtgcgtcacgaccggtgctcgatttagatcgtctgtggttggggtttgggggagtcagaccctgtcaggacacagcatggacatggacgggtccccgctcagcctccgtggggcctcctgctgctcgtcggcctcccgacggtaccagtctggtcgactactacctaacgttaccgaccctacgttcctccctaccttccccttcccttacgtcctcgaccttacttccgttaaggttacgggaacgtaacgaacggtacgtacccaacctaccgtaccgtaccggttccggggcccggggtacgtacggtaccgaccggacctactaccgtacgtacgttacgttttaccgtttaccggccgtttggtaccgaccgtaaccggaaccgtaaaaccgggaacccggtcggggaccccgtacccgaccccgtaggaacgttacgttcggtacgttacgtacggtcggtaccaccgtacgttaacgtacggttacggttacggacgggttaccgggggttcccggaccttacgggtaccggttaacgggttacggtacgggtacggtcgttacgggtcctacgttacggttacgggtacggtaacttacgttaccttaccgtacctcgtacctacgtacacgcgaccgtacgtccgacggtaccgtacgttagtaacgtttacgttactttacgttaaccttttaagttacgtaccgtaattaaccgtttaacgttacgtttaacccgttaacccggttacccgttacccgggttaggtacccgggttacccggtaaccggggaaccgggtacgggtaaacggttacgggaaccgttaacccggaacgttaacccgtagggtttcccaccggttcgcccgtaaccg

SEQ ID NO: 215338 - DNA, 743 bp, Homo sapiens
  misc_feature: GYAE6OF01B7TM7.1.34.D01.1.454.CMB.1.raw
  modified_base (104)..(104): a, c, t, g, unknown or other
  misc_feature (104)..(104): n is a, c, g, or t
tcagacgagtgcgtcacgaccggtgctcgatttagatcgtctgtgttgggtttgggggagtcagaccctgtcaggacacagcatggacatggacgggtccccgntcagctccgtgggctcctgctgctcgtcggctcccgaggtaccagctgtcgactactacctaattcgaccctagtcctccactccctcctgtctgctatcgtagtaggagacagactaccactatacacgtcggccggagacgtcgacggacacgtcgacgtcgtatttcgttacgtcgtggtcgacgagacgaacggaaccggaggccgaccgccctagacgtacgtacgtagtcgtagtggtacacactccgtagtacgtacggacggtaacggggtccgtacctacgtcggtaacggttcacgggtcgtagtacgtcgacgtacgtacgggtaaggtaacgtacgtaaccttacctaacgttcctaacctaactacgaccgtacgaccgtcgccgtacggacctaaccggtacgttaaggttaacgttactttaacgtaacgttttaacgtttaacgttaccgtacgttaaactaacgtttaactttaaccgttaccgtaaacccggttaccggtacggttaccgggttaccggtaccggggaaccgggtaacgggttaaccggtaagggttaaccgtaaacccggttaaccggaacccgggtttacggtacggtaccggtacgtacccgtaaccg

SEQ ID NO: 215339 - DNA, 810 bp, Homo sapiens
  misc_feature: GYAE6OF01ACJPB.1.34.D01.1.454.CMB.1.raw
  modified_base (103)..(103): a, c, t, g, unknown or other
  misc_feature (103)..(103): n is a, c, g, or t
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (166)..(166): a, c, t, g, unknown or other
  misc_feature (166)..(166): n is a, c, g, or t
  modified_base (450)..(450): a, c, t, g, unknown or other
  misc_feature (450)..(450): n is a, c, g, or t
tcagacgagtgcgtcacgaccggtgctcgatttagatcgtctgtgttgggtttgggggagtcagaccctgtcaggacacagcatggacatgacgggtccccgntcagctccgtggggctcctgctgctctggacctccagtaccngctgtnacatccaatcgaccngtctccatcctccctgtctgctacttactacgtaggacgaacagacgtaccactaacgtcgtacgttcggccggggtactacgtccgaggtccagttccgagtaccgttacttcgtttacggccgttaggttacaccgacgtaaccgaaacggaacccggtggggaccctaccgtacccccgttagacggttacttaccggttaagttacctaacggtggtcctacgtaccgacgtaggtagttacggaccggttagggtccgtaccacgttcccgtaggtacnggtgacgtacgcgacgtatcggagtactacgtactaccacttacgaactactacacgtacgtaccgacgtcgtacgaactacggtaacgtacgttaacggtttacgtttaccgttaaacgttacgttttaaacgtaccggttaaccttaacggtaaacgtttaacggttttaaaccttacccggttaaaccgggtttaccccggttaacgggttaaccccggggtaccgggttaaacccggggtaacccggggtaaacggggtaaacggttaaccgggggttaaacggttaaaccccggtaccggtttaaaaacccggtccggttaaacgggtacccgttaacgggtaccttaaacccgg

SEQ ID NO: 215340 - DNA, 952 bp, Homo sapiens
  misc_feature: GYAE6OF01BNM82.1.34.D01.1.454.CMB.1.raw
  modified_base (105)..(105): a, c, t, g, unknown or other
  misc_feature (105)..(105): n is a, c, g, or t
  modified_base (158)..(158): a, c, t, g, unknown or other
  misc_feature (158)..(158): n is a, c, g, or t
  modified_base (691)..(691): a, c, t, g, unknown or other
  misc_feature (691)..(691): n is a, c, g, or t
tcagacgagtgcgtcacgaccggtgctcgatttagatcgtctgtggtttggggtttgggggagtcagaccctgtcaggacacagcatggacatgacgggtccccntcagctccggtggggcctcctgctgcttcgtcggaccctcccgaaggtacccngtccgtaggtacgaacctacttaccctaaagttcccggaaccctacgttcccttaccctaccgtttccccccttcccgttgtaccgttacgactacgttacgttaaggttcggaagaccgtacggtaacctaccctaaccgtacttccggtaaccgggttccggggacccgggtacggtacgtaccgacggacctagtacggaacgttacgttttaccgtttcgttttacggccgttaggggttaccacaacggaacgaaaaccggggaaccggccgggacccctcccgtaccctaaggacgttaccgtttacggtacgttacgtaggttccggacctacgtaacgttacgagtttacggtaccggggaacgggtttacccgggggtaccccggtactaaaccggtttcccgggttacggggtaccggtacgggtacgttaccggttaacgtcgggtacggtttaacggtaacccgggtaacgggtaactttaaccgtttacccttaccgtaccccgttacaaccggtttaanacccgagtacccccggattccccgggtactaccggggtaccacgggtttacggttaaccttagtttacggttaactttacgttactttaacgtacgtaccttaaacgttacgtttacgttaaccgttaccggttaaccgtaccgggtttacggtaacccgggttacgggacccgggtaaacggggtcggttaaacgggttacccggaacggttaaaccgaccgggttaaccgtacgggttagccttaacggtcccgtaccg

SEQ ID NO: 215341 - DNA, 806 bp, Homo sapiens
  misc_feature: GYAE6OF01C9SVC.1.34.D01.1.454.CMB.1.raw
tcagacgagtgcgtcacgaccggtgctcgatttagatcgtctgtgttgggtttgggggagtcagaccctgtcaggacacaacatggacatgagggtccccgctcagctccgtggggctcctgctgctctggcctcccgaggtaccagctgtagacatccaattcgacccagtctccactccctcctgtctgctactctaagttggacgacagtagtccaaccacttcctaacggttcggcccggggacgtacggtaccgacgggtaccagtccgtaacggcgttaacgtttccgtttacggtcccgttgggttacggaccgtaacggaaccgaaacggaaaaccccgggtacggggtaccccgacccgtacccccgttaacgtaacggtaaccggttccgggtttaagtacccgttaagggttcgggtacgacctaccggtaccgaagtacgttacggaacggtacgggttcccggtacccgtacgttccggtaacggttcgtaggtacggtcgacggtacgtcgtagtaccggtaggactacggttacttaaccgtctctaactactatcgacgtacgcgtacctacgcgtaccgttacgtaggttaacgttttcgttaacttaaagttttacgtttaacgttacgttaaccggtaaattacgggttaactttaacgttaacccgttacccgttaaccgggttaccgggttacgggtacccggttaccggacggggtaaccgggtaacgtagggttacgaaaccgttacgaaacggttacgtacggtaggcctcgtacctaaccg

SEQ ID NO: 215342 - DNA, 923 bp, Homo sapiens
  misc_feature: GYAE6OF01DWQ6T.1.34.D01.1.454.CMB.1.raw
  modified_base (197)..(197): a, c, t, g, unknown or other
  misc_feature (197)..(197): n is a, c, g, or t
  modified_base (902)..(902): a, c, t, g, unknown or other
  misc_feature (902)..(902): n is a, c, g, or t
  modified_base (911)..(911): a, c, t, g, unknown or other
  misc_feature (911)..(911): n is a, c, g, or t
  modified_base (917)..(918): a, c, t, g, unknown or other
  misc_feature (917)..(918): n is a, c, g, or t
tcagacgagtgcgtcacgaccggtgctcgatttagatcgtctgtgttgggtttgggggaggcttgataaagccgtggggggtccctgagactctcctgtggagcctctggattcctacctttggaacctacgccatgagcgtgggtccgcaggcctacggagggggaaggggctagggaggttcgggtcctccggtnttagttaggtgggtaggtgggccggtagcacgtaatacgtacgcaaggtaccgtccgggtaggaacggggtcccggttaccaacccgtacttcccgtaccccggaaggtaacctaacgtttccggaactaacggtaaaccgtttcggggttttttagtttttcggaaaccgtaaaggttacggaaccgacgtacccggttagggaacggtacgggtaccgggtaccgggaaccggtacccgggtccggtttactttaagtttacggtttcggacgggaccgtaccggtaccggttactttaagttaaacttaaagttaacgtacgggtaccgttacgggtacgggggaacccgtaaacggggtaccccgtggttacccgtaaccgttccgtacctaccgaccgtccccgtaccggtaaacccggacccgggtacccctaccggtttccccggtcccctttacccccgggcggtcccgttcccgtacggtccctaaccggacgggtaccgacccgttacccggaccggaacgcgtaccccgaacggtcgggtcccgggttccccggaggggtccctccgggtaccgttacggaacccggtaaccgttaacccgtttccccctacgggtaaccccgtccggttaacccgtccggtaccgttaggggtaacccgggtcggggtcccgagggtaacccgaccggtacgngttaaccgngagcgnngtgcg

SEQ ID NO: 215343 - DNA, 666 bp, Homo sapiens
  misc_feature: GYAE6OF01EPE0M.1.34.D01.1.454.CMB.1.raw
  modified_base (200)..(200): a, c, t, g, unknown or other
  misc_feature (200)..(200): n is a, c, g, or t
  modified_base (267)..(267): a, c, t, g, unknown or other
  misc_feature (267)..(267): n is a, c, g, or t
  modified_base (329)..(329): a, c, t, g, unknown or other
  misc_feature (329)..(329): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtacccagctgtgacatccaattgacccagtcctccatccctccctgtctgcatctattgganacagagtcaccatccacgttgccgggtcagtcacggccatcagacgtattctttagtccgtggttcncgagacaacggaaaccgaggggccgaccgcccctagacgtactcggtagttctagtcggtanctactaccagtagttcggacgtagggtcggtacctacgtcgtaggttcaggtcgtcagtcgctagtcggacgggactaacggtacttaccaccttactactaactacacgtacgccgtaccgacgtcgaccgtacgtaccgttaacggtaatttacgtttagtaactttaagttttaaccttagtacctaaacgtaaacttgttaaacgtttacggtaacccgttccccgtagggtttaccgggtaccggttaccgggaaccggtaacggggtaaccgtacgggtaacggtaaccgtaaccgtaaccggtacgtagggtacgtccgtacgtaacccg

SEQ ID NO: 215344 - DNA, 714 bp, Homo sapiens
  misc_feature: GYAE6OF01AE91B.1.34.D01.1.454.CMB.1.raw
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccactccctccctgtctgctatctagtggagacagactcaccatcacgttcggccgggcgtacgtcgacggcctatcgaggtaccgttactttcgtttacgccgttggtcgacacgaccgaaggaaacccgggggaccncccgacccaganacgttccgtagtcgtagtgngacancagtcgtaggcggtagggtccggtccatccgtaggtcgagtcggntggctcgacgtcgaggtacagtactaccgcttacactctacgcgacgcaccgtccgtacgcgtacgtactaaggtttaattacgtttacgttaacttttaacgtttaaccttacgtaacggttaaccttaaacgttaacgtttaacgtttaacccgttacccccggtttaaacggttaaccggggtaacccggttacccggggttaaccggggtaacccgggggtaaacggggtaaacccggttaaaggggtaaaccggtaaacccgttaaaccgggtaaacccgggttcgttaggggtacccggtacgttccggtaccccg

SEQ ID NO: 215345 - DNA, 920 bp, Homo sapiens
  misc_feature: GYAE6OF01AXI9F.1.34.D01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtctccatccctcctgtctgctatctagttggacacagacgtcaccatctacgttcggccgggngagtcaggccatcgagacgtactttcgttacgtccgttggttacgacgacgtacgaacggtaaaaccggcggggaccgtaccgcccccgtaacgtaggtaacgttccggttaacgttccgttaaggttcggtacggtacctaaccgttaccgaagttacggtaccggaacgggtaacggggttccgggtacccctacggttcccggtaacgggttaccgagggtacggtacgtaacggggttcaccgtagggtaccggttacggggaataacggtaactttaccgtaacctcgtactaaccgtacgtaccgagggtacctacggtccttaaccggcgttaaccggtaccggttaagttaaacggttttactttacggttaaaccttttaacgttttaaacccgtttacgtaacgttaaacccgttaacgttaacgggttttaacctttaacccgggttaaccccggtttaaccccgggtttcgggttaaccgggggttaacccccgggtttaccggggaacccgggtaacccgggggttaaaccggtaacggggttaaacccggtaaaccggttaaaccccggtaaacggtaaccgggttcgggtaccggggtaaccttaccggttacccgaaccccggtttagtttacccccgggtttacttaccggtttaaccccgtacccccttttaccccccggtttccctaaaccccccggg

SEQ ID NO: 215346 - DNA, 679 bp, Homo sapiens
  misc_feature: GYAE6OF01AD6YV.1.34.D01.1.454.CMB.1.raw
  modified_base (486)..(486): a, c, t, g, unknown or other
  misc_feature (486)..(486): n is a, c, g, or t
tcagacgagtgcgtcacgaccggtgctcgatttagatcgtctgtgttggatttggggggagtcagaccctgtcaggacacagcatggacatgagggtccccgctcagctcctggggctcctgctgctctggcctcccgaggtacccagctgtgacataccaattcgacccagtctccactccctccctgtctgctactctagtggagacagacgtacacctatccacgttcggccgggcgagtccgaggccagtcaggtcgtactttcgtttacggccgttgggttcgctacggaccgaacggaaaacccggaggggacccgaccggtccccccgtagacgtacttcggttacggttctaaggttcgggtcgcctacgtacccgtaggttacgttcggaacggtaacgggtcgggtaccctacgtccggtaggttccgaggtcggcgtagtcgactacgttacgtacgggactacgtacttaaccnccgttcctactacctatccaaggccacggtctacgaccgctacggtagtacgtttcttacgtaactttaatttcgtaagttacgactaacgttaagttaccttaagtacccggtacccttacgggacgttaccgggtccggacggacgggtacgagggtacgtaaccgaacgtaccgagttcggcgtgtaccg

SEQ ID NO: 215347 - DNA, 770 bp, Homo sapiens
  misc_feature: GYAE6OF01E5FZA.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtggggctcctgctgctcgtggcctcccgaggtaccagctgtgacactaccaattcgaccctagtcctccactccctccctgtctgctatctagtggacacgagtacgtccacctatccacgttcgggcccgggacgtacgtcgaacggcctaagttcgaaggtcgttacgttttaccgtttacggtcccgttgggttacgaccgtaacgaccgtaaacggaaacccggacggggtaccgacccggtcccccgtaggaacgttacgtacggttacgtacgttaggtcggtcgtacctactaccgaagttacgtggacggtaacggggttccgggtaacccctacgtaccgggttaacggtacgtacgggtcggaactcgggtacgtacctaggtcggacgggtaactagttaacctacgtaccttctaccgtactagtaccacgtacgtacgtccgtagacgaccgttacgtaaggttaacttttagtttacgaaacttttacgtttaacgtacgttaccgtaaacgttaacttaggtttaaccttaaccgttaccggtacccgttacgggttacgggtaacccggttcggaacccgggtaagggaaccgttagggaccgtaacgtaccgtaacggtacggtaggtcacgtccgtaaccg

SEQ ID NO: 215348 - DNA, 540 bp, Homo sapiens
  misc_feature: GYAE6OF01DGBAD.1.34.D01.1.454.CMB.1.raw
  modified_base (132)..(132): a, c, t, g, unknown or other
  misc_feature (132)..(132): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (506)..(508): a, c, t, g, unknown or other
  misc_feature (506)..(508): n is a, c, g, or t
  modified_base (511)..(540): a, c, t, g, unknown or other
  misc_feature (511)..(540): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtncatccagattgcaagggtcggggtcccatccaggttcagtggcagtgcatcgtgggacagtattacactctcactancagcagccngcagcctagtatattttgactaattttactactgtacaactagttaacttataccgtaacccctaggtacggtaccggttccgggaccggaacgggggaaccgtaagggtacggtaacgtaccgaaaacccggtacgttgggtacggcgttacgaccgaacttacgttcgtacgttaccttacaccgtttcccttaccccgacttacgtaccgtaacgaaccgtcaccgttcgtcggtagaccgggtacgggtccgtaggaccgaacgggcgtactagtacgnacngnnnctnnnnnnnnnnnnnnnnnnnnnnnnnnnnnn

SEQ ID NO: 215349 - DNA, 767 bp, Homo sapiens
  misc_feature: GYAE6OF01DV6G8.1.34.D01.1.454.CMB.1.raw
  modified_base (189)..(189): a, c, t, g, unknown or other
  misc_feature (189)..(189): n is a, c, g, or t
  modified_base (260)..(260): a, c, t, g, unknown or other
  misc_feature (260)..(260): n is a, c, g, or t
  modified_base (579)..(579): a, c, t, g, unknown or other
  misc_feature (579)..(579): n is a, c, g, or t
tcagacgagtgcgtcacgaccggtgctcgatttagatcgtctgtgttgggtttgggggagtcagaccctgtcaggacacgagcagtggacatggacgggtccccgctcagcctccgtgggcctccgtgctgcctcgtcggcctacccgaggtaccagtctgtacgaactactacctaattccgaacccngttcctccactccctcctgtcctgctatcgtagtggagaccaggactcaacctatccgtacgtcggccggngtacgtcgacgacagtcagtcgttactttcgttacgcgttggtcaccgagacgaaacgaaccggcgggtccgaacccgcccctagaagttacgtacggtacgttctaggttcggcacctactacgagtactcgggtacgtaacgggggtccggtaccctacttcgggtaacggttgaacgggtcgacgtaggttcgacttacggtcggaaggaaactgtttaactacctaccctacgtactaacgtaccgtcgaacgtccgtccggtaccgtacggcccgttacgtaacccggtttagtaacgttttaaccggttttanaaaccggttttaagttttacctacggttaacggtaaaccttaaacggttagtttacccgttaaccgtaaaccggttacccccgttggggtacccgttaccggggtacccgaacggggtaaaacggtccggtaaggaaaccggtacctaacccggtaaccgggtagtcggaccggtctacggtaacccc

SEQ ID NO: 215350 - DNA, 887 bp, Homo sapiens
  misc_feature: GYAE6OF01E5VZ9.1.34.D01.1.454.CMB.1.raw
  modified_base (105)..(105): a, c, t, g, unknown or other
  misc_feature (105)..(105): n is a, c, g, or t
  modified_base (476)..(476): a, c, t, g, unknown or other
  misc_feature (476)..(476): n is a, c, g, or t
tcagacgagtgcgtcacgaccggtgctcgatttagatcgtctgtgttggggtttgggggagtcagaccctgtcaggacacagcatggacagtggacgggtccccntcagcctccgtggggctccgtgctgctcgtggcctacccgagggtaccaggtctaggtagacctactaccctaagttcgacccgtagttccctaccctaccttccccttacccgtggttccacgtaccgtacttaccgttaggtacgggaacgaacgtaacgtaccgtaccgaacctacgtccgtaccgggtttccggggaccccgggggtacgtacggtaccggaacgggtaccctaagtaccgtaacgggtccgttaacgtttttaccggttacggtcccggttaggtaccgactaacggaaccggaacggaaacccggcggggaccctaccgtcccctagaacgttacgtacggtagtcgtagtcggngacctagcgtagtacgtacggacggtacggggtcgtacctacgacggttggtagccgtggtacagtaccgacgtacgtaccgggaggtactaagttacctacttaccgtcctaacgtacgtaaccgcgtaaccggctaacccggtcgtaccggaacgtccgtaagttaagttaccgtttaggtttaacttaacccgtttttaatttaccgtacgggttaaccttaaacgttaaacgggttaatttaaccccgtaacggtttaacccccggaccgggttttacgggaaccggggttacccggggttaaccgggaaccggggttaagggtaaacggttaacggggaaccgtttaaaccccgggaccggttaaaaccgttcgggtaccgggtacgttaccgacccgggtttacc

SEQ ID NO: 215351 - DNA, 541 bp, Homo sapiens
  misc_feature: GYAE6OF01A6RTZ.1.34.D01.1.454.CMB.1.raw
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (512)..(513): a, c, t, g, unknown or other
  misc_feature (512)..(513): n is a, c, g, or t
  modified_base (519)..(519): a, c, t, g, unknown or other
  misc_feature (519)..(519): n is a, c, g, or t
  modified_base (521)..(525): a, c, t, g, unknown or other
  misc_feature (521)..(525): n is a, c, g, or t
  modified_base (527)..(530): a, c, t, g, unknown or other
  misc_feature (527)..(530): n is a, c, g, or t
  modified_base (532)..(533): a, c, t, g, unknown or other
  misc_feature (532)..(533): n is a, c, g, or t
  modified_base (535)..(541): a, c, t, g, unknown or other
  misc_feature (535)..(541): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaagggtgggtcccatccaggttcagtggcagtgcatctgggacagtattacactctcaactatcagcagctgcacgcctaggactagtttttgacttaattttactactgtacaactagttattactacgtacccctaggtggtacgttcggaccgtagggaccaaggtggaagtccaaaccgacgttgtcggctacgacactatcttcgtccttagacttccgtcccgacctagtttccagtaaaccgtctaccggttacgttccgtaggaacccgggtcgggtaccgttaggacccggtaaagggttcccggaactaaacggtttggatccgaangtactnaagtcngtacgtnagtcgngcntagnngcagcncnnnnngnnnncnncnnnnnnn

SEQ ID NO: 215352 - DNA, 724 bp, Homo sapiens
  misc_feature: GYAE6OF01EAK4L.1.34.D01.1.454.CMB.1.raw
  modified_base (103)..(103): a, c, t, g, unknown or other
  misc_feature (103)..(103): n is a, c, g, or t
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagaccctgtcaggacacagcagtggacatggagggtccccntcagctccgtgggctcctgctgctctggcctcccaggtaccagctgtcgacatccaattcgacccagttcctccacttccctcctgtctgctatctatgganacagctcacattcacgttcgccgggcgtagtcgacggtcagtcgagtctatttccgttagtccgtggttcgactaacgacaaacggaaaccgnggggccctaccggtcccctagacgtacgtccgtagttactagtggtacatactcgaagtacgttcggaacgtaggggtccggtaccaggtacccgtaggttccgagggtacggntacggtacgacttacggtacggtacgggtaaacttcggtaaccttaccgtacccttcgtactaacgtttaacgacgaccggacttacgccccggtagacccgtaccgttcggttaaggttaacttttacggttttaccgaatttttaaccgtttaacgttacccgtagggttaaccttaaacgttacgtttaacgttaaccttacccgggtaaccctttaggggaccccgggttagtaccggggaaccggtaaagggttaccgaggtaacggtaactaaacccgacgtagttcgtacggtaccggtaacccg

SEQ ID NO: 215353 - DNA, 822 bp, Homo sapiens
  misc_feature: GYAE6OF01E0H0H.1.34.D01.1.454.CMB.1.raw
  modified_base (102)..(102): a, c, t, g, unknown or other
  misc_feature (102)..(102): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctcccaggtaccagctgtgacatccaattcgacccagttcctccatcccgtccctgtctgctattcctagttgganacagtagtccaccntcgacttgccgggcagtcaggccatcagcgtattcttagccgtaggtcgcagcacgtaaccgngggacaccgtccctgatatcggtatacctagtggtacgactactaccgagtacgtcgacggtaacgggttccgggtacccagtcccgtaggttacaggtcggactagtcgactagtccggtagggactacgttaactaccgtaccttacctacgtaacctacgtaccgaacgggacttaacggtccccgttaggacccgtaaccgtacccggtttaggttaaaaccgttttaggttttaccggtaaacttttaaacgtttttaacgttaacccggtttaaactttaaaccccggttaaacgtttaaaccgtttttaaaccgtttaacccgttaaacccggtttaaaccccccggttacggggttaacccgggttaaaacccgggttttaccccggggaacccgggttaaaacccggggggttaaacccggtaaaacggggggtttaacccggaaaacccggttttacccccgggaaaaaccccggttaaccgggtttaccgggtttaacccggggtcccttaacccgggttaacccccg

SEQ ID NO: 215354 - DNA, 749 bp, Homo sapiens
  misc_feature: GYAE6OF01B8KJN.1.34.D01.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (530)..(530): a, c, t, g, unknown or other
  misc_feature (530)..(530): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggcctcccaggtaccagctgtgacatccaattcgacccagtcctccattcctccctgtctgcatctagttgganacagacgtcaccatcacgttggccgggacgagtcaggccatccgagcgtactttcttacgccgttggttcgcagcgaagaaaccgngggccgacgcccctagacgtactcgtagtctagtcggtcgactacgtaccgagtacgttacggacggtaacgggggttccgggtaccctaacgttacccggtaacggttccgtaagggtcggaccgtaagggtcgacgtacgttccggtacgggtactagttaactttacccgaaccttcctactaacttacgacgacgccgtaacgtccctaggacctacgtaccgttagtaaacgttttnttttacgaactttaacgtttttaagtaccgttacgtaacgtaaacgttacgttttaacgttaccgttacccggtttaaccccggttaagggttaccgggttacccgggtttaccccggggaaccgggttaaacggggtaaacccggtaaaggggttaccgaaaaccggttacccgttaaaacccggtggttacgggtaccggtcgtccggtaaaccccg

SEQ ID NO: 215355 - DNA, 772 bp, Homo sapiens
  misc_feature: GYAE6OF01CHUC0.1.34.D01.1.454.CMB.1.raw
  modified_base (210)..(211): a, c, t, g, unknown or other
  misc_feature (210)..(211): n is a, c, g, or t
tcagacgagtgcgtcacgaccggtgctcgatttagatcgtctgtgttggggtttgggggagtcagaccctgtcaggacacagcagtggacatggacgggtcccccgctcagctccgtggggctcctgctgctgtcggctccccgaggtaccagtctggtacgacatacccaagttccgaccctagtcctcccacttcccctcctgtcgtnntacttctagtggacgacagtactcaccctataccgacggttcggccgggtacgacgtaccgacggacctaagtccgagtctactttcgttacgtccgttggttcacgacgtacgaacggaaccggcgggaccgaccgtccccgtagacgtcgtacgttacgtactaggtcggtacactacgtcagtacgtacggacggtacgggccggtaccacgtcgtagtcgacggtgacgacggtctagcgtggacggtactaagtactaccgtactacctactaacttagaccgacgtaccgtaccggccgtaagtaccgtacgtaccgtaacggtttagttacgtttaacgtacgttttaaacgtttaccttaacggttaaaccgtaacttaaaggtttaaaccttaacgtttaacccgttaacccgggttaacccggttaacgggttaccgggttaacccgggtacccgggaaccggtaacgggggtaaccgtaaacgggttacggtaaacccggtaaacccgtaacgggtacccggttaggggtaccctcgggaccggttaaac

SEQ ID NO: 215356 - DNA, 866 bp, Homo sapiens
  misc_feature: GYAE6OF01ETFOK.1.34.D01.1.454.CMB.1.raw
  modified_base (621)..(621): a, c, t, g, unknown or other
  misc_feature (621)..(621): n is a, c, g, or t
tcagacgagtgcgtcacgaccggtgctcgatttagatcgtctgtgttgggtttgggggagtcagaccctgtcaggacacagcatggacatggacggggtcccccgctccagcctccgtggggcctcctgctgctcgtcggcctcccgaggtaccagcttggtcgactactacctaacgttcgaaccctagttccctaccctacttccccttcccgttggttcctcgtctacgttcttagttgggacgaccgaacggtacgtaccaacctacttccgtacgttcgggcccgggacgacgtcgaccgtccacgtcgacggtcgtttatttaccgtttacggccgttgggttacgcgaacggaaccgaaaacggaacccggacgggggcccgtaaccccgccccgtacgaggttaacttcggtaagtttaccgtaggttcgggtaccacgttaaccaccgtaaggttacgtttacgggaccggtaacggggggttccccgggtacccttaacgtaccgggtttacggtaggtagggtcgggacctagggtcgtaccgtaggtacgggtaaggaacttacttaacttacccgtacctccgttactaacgtacgtaccgcggtacnccgcctgacgaacgtcgtaagtaaggttttctttaacaacgttttaatttaacgttacgttacggtaactttaaaccggttaatttaacgtttaacccgttaccggtaacccggttcggggtaaccgtaacccggggtttcccgggaaaccgggtaacgggtacccggggttaaaaggtccgggtaaaaccgttaaccccggaaaccggttacgtaccgggtttccggaacgttaacccggtacc

SEQ ID NO: 215357 - DNA, 688 bp, Homo sapiens
  misc_feature: GYAE6OF01BMAEG.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagcctcctggggctcctgctgctctggctcccaggtaccagctgtgacactccaattcgacccagtcctccatccctccctgtctgctacttctagttggacgacagtacgtccacctactccgtacgttcgggcccgggtcgagtccgacggcccagtccgacgcgtatttccgtttagccgttggttcgcagacgaacgaaccgaggggaccaccgcccctgacgtactacgtagtctagtcggtacactactaccgtagtcgttacggacggtacggggttcgggtacccctagtacccgtagggttccagggtacgtcgtagacgtctacggtccgtagggactacgtacgttaccacgttccgtactactacgtctacggacctacgcgtacgtcgtacgtaccgtagtaacgttatttacgatttaactttaacgtcttacgtacctaagttacgtttaactacgttaacccgttacccggtacgttagggtacccggttacgggtaccgtaacgggggtaacgtacggggtacaaccggtaccgaaccggttagttcgggcgtaccggtcaacccg

SEQ ID NO: 215358 - DNA, 632 bp, Homo sapiens
  misc_feature: GYAE6OF01EVVWC.1.34.D01.1.454.CMB.1.raw
  modified_base (196)..(196): a, c, t, g, unknown or other
  misc_feature (196)..(196): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccatctccatcctcctgtctgcatctatgganacagagtcaccatcacttggccggcgagtcaggccatcagctattcttagcctggttgacaacagaaaccgngggcgacgccctanagactcgtagtctagtggngcatccgaagtacttggacgtaaaggggtcggggtaccccagtaccgtagggttacagggtcggacgtaggtggtacagttcggtacggggaactaggtaacttacaccttctaactactaatcgaacgctacgtcctggacctaggcccttaaggaacttacttttacgaatttaaactttagttacctagtaactaaacgtaagtttaactactaaccggttaacccgtaggtacggtaccgtaccggacgggtaaccggggtaacgaacgggttaggaaaccgtaccgaaaaccgtacggttacggtacggtcttagacccgtaaacc

SEQ ID NO: 215359 - DNA, 589 bp, Homo sapiens
  misc_feature: GYAE6OF01A6XLZ.1.34.D01.1.454.CMB.1.raw
  modified_base (322)..(322): a, c, t, g, unknown or other
  misc_feature (322)..(322): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttggggagtcagaccctgtcaggacacagcatggacatgacgggtccccgctcagctccgtgggctcctgctgctctggctcccgaggtaccagctgtgacatccaattgacccagtctccatcctcctgtctgcatctagtggagacagagtcaccatcacgttcggccgggcgtagtcgaggccagtcgaggcgtatttcgtttacgccttggttgcagcaacggaaaccgagggccgacgcccctgaagtactcgtagtctagtggtncatccgagtatgacgtaagggtcggtccagtccgtaggtcaggtgctagtcgctagtcgaggacagtactacactctacatacacgacnctagcctagacacgcgtagtaacgtttatttcgaactttaattttacgtactagtaacgttaacttaagttaacgttacttaaccggttaccccgttaggtaccggttacggtaccggaccggaacgggtaacgtaggtacgtaacgtaccgaacggtagttaggccgagtcgtaccg

SEQ ID NO: 215360 - DNA, 581 bp, Homo sapiens
  misc_feature: GYAE6OF01CA40K.1.34.D01.1.454.CMB.1.raw
  modified_base (424)..(424): a, c, t, g, unknown or other
  misc_feature (424)..(424): n is a, c, g, or t
  modified_base (572)..(572): a, c, t, g, unknown or other
  misc_feature (572)..(572): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggctcccaggtaccagctgtgacatccaattgacccagtctccatcctccctgtctgcatctattggagacagagtcaccatcacttcggccggcgagtcaggccatcagcgtattctttagcctggttgcagacaagaaaccgagggcgacgcccctcagatcgtacgtctagtggtgacagtccagtattcggacgaacgggtcggggtcccagtccgtaggttctaggtcggtacgagtcgactagtcgtaggggactaggtattaccgacttctacgacttacgcagaccngtcctgcctagacctacgtaagttacttttacgacttaaagttttacttacgtcgtaacctaagttacttattactaccgtaaccttacggtcgtacgttcggccgagggaaccgtaggtcggaaacgtacgaacggtacgtgtcggngtcgaaccg

SEQ ID NO: 215361 - DNA, 688 bp, Homo sapiens
  misc_feature: GYAE6OF01BD3WB.1.34.D01.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (310)..(310): a, c, t, g, unknown or other
  misc_feature (310)..(310): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatcctccctgtctncatctatggaganagatcacatcacgttggccgggngagtcaggccatcgagctatttcttagtccgtggtgcagacaagaaaccgagggcacgcccctacgagacgtcgtagttctagtggngacataccagtattcggacgtaacggggtcgggtacctacgttaccgtaggttcgaaggtggacgagtgactaggtaccggtagggtactaaggtaacttaaccgtactccgtacctaacttaacgtacaacggacgtaccgcccgttagactaccggtaccgttaagtaagttacgttttaaggtacttaaaagtttttacttaacgtagttaacctaaagtaatttaagttaaccgttaccggttaccccttaacgggttaccggtaccgggtaacccgggacgggtaacccgggggaaacgttaaacggggtaagggtaaaaccgttacccgtaaaacccggttagtaccgggttcggtaaccgtggtaaacccg

SEQ ID NO: 215362 - DNA, 793 bp, Homo sapiens
  misc_feature: GYAE6OF01DCUC9.1.34.D01.1.454.CMB.1.raw
tcagacgagtgcgtcacgaccggtgctcgatttagatcgtctgtgttgggtttgggcatggacatgagggtccccgctcagctcctgggctcctgctgctctggcctcccaggtaccagctgtgacatcctaattcgacccagtcctccactcctccctgtctgcatctatggacacagagtccaccatacgtacttcggccgggacgtacgtacgcggacctagtacgagtacgtacttttacttacgtccgttggttcgacgagaccgaaacggaaaaccggacgggaccgacccgtcccctacgaagtacgttcgtaacgttcgtaagtcggtacgactacgtaccgaaggtacgttacggacggtaacggggtcccgggtaccctacgttacccggtaagggtttacaacgggtccggtacgtggttacgacgtaacggttcgggaacgggtaactaaacgttaacgtaacctaccttactacctaactaacgtaccgacgtacccgtacggtacctacggtaccgtaacgaacgtttaggtaactttacgtttacgtactttaactttacgttattaacgtaaacctaagttaacgtttaactttacctaaccggttaacccgttaaggggtaccggttaccgggttaccgaaccggggtaacggtaacgttagggtaaccgtaaccgtaaaccggttaacccggtagtaccgggtacgaccttccgaccgttaacctagtttccgttaccttacctttacgaccctttcccccgttcccctaccccg

SEQ ID NO: 215363 - DNA, 797 bp, Homo sapiens
  misc_feature: GYAE6OF01BRUTR.1.34.D01.1.454.CMB.1.raw
  modified_base (150)..(150): a, c, t, g, unknown or other
  misc_feature (150)..(150): n is a, c, g, or t
  modified_base (554)..(554): a, c, t, g, unknown or other
  misc_feature (554)..(554): n is a, c, g, or t
  modified_base (582)..(582): a, c, t, g, unknown or other
  misc_feature (582)..(582): n is a, c, g, or t
tcagacgagtgcgtcacgaccggtgctcgatttagatcgtctgtgttgggtttgggggagtcagaccctgtcaggacacagcatggacatggacgggtccccgctcagctccgtggggcctcctgctgctcgtggcctcccgaggtaccngctgtagactactaccaagttcgaccctacgtcctccactccccttcccgtgtcctagctatcgtagttggacgacgagacgtccaaccatcgacgttcgggccgggacgtacggtaccgacggcctagtcgacgtaccgttacttttaccgtttacggccgttggttcgaccaacggtaccgaaacggaaacccggtacgggaccccgacccgtaccccgtacgtaagtacgttaccggttacggttaccttaggtggtacaccgtaacgtaccgtaagtacgttacgggaccggttaacgggggtcccggtacccgtacgtacccgggttagttacggaggtacgggacgttaggcgtaccgtaggtttacgggaacggtaactaacggtttcctaaccctntacccgtataccctagtaccgcaccggntccgtagtaccgagtacgttagttaacgttctttaacaatttacttttaacgttccgacgtttaacgaaactttagtttaacccgtaaccgtttaccccgttaaccggtcgggtttaaccggtacgttcccggggaaaccggttaccggggaagttaaaccgggtacggtaaaccaacccgggttacgacggttcgggacccgtctcggtaaccc

SEQ ID NO: 215364 - DNA, 793 bp, Homo sapiens
  misc_feature: GYAE6OF01CJGFT.1.34.D01.1.454.CMB.1.raw
  modified_base (269)..(269): a, c, t, g, unknown or other
  misc_feature (269)..(269): n is a, c, g, or t
  modified_base (777)..(777): a, c, t, g, unknown or other
  misc_feature (777)..(777): n is a, c, g, or t
tcagacgagtgcgtcacgaccggtgctcgatttagatcgtctgtgttgggtttgggggagtcagaccctgtcaggacacagcatggacatgacgggtccccgctcagctccgtgggctcctcgctgctctcggctacccgaggtaccagctggtagactactacctaattcgaccctagtctccatccctccctgtactgactacttctagtggacgtacagtacgtcacctatcgtacgttcgggccgggcgtagtacgacggtaccngtacgaggtcgttaactttcgtttacggccgttgggttacgaccgtacgaccgtaaacggaaaaccggcggggtaccgaacccgtccccgttacgaacggtaccgttcggttaaacgtccgttaaggtcgggtccaacgtacgttaccgtaacggtatttaccgggaacgtaacgggggttcccggtaccccgtaaattcccgggtaacggtcggtacgggtcggtacgttaacggcggtaactacggttacgggtaacgggtaacttaacgtaaccttaaccgtacccgtaccgttacctaagttaccctacgacggtacccgacgtccgtaacgccgtaacgccgggttaaagtttaactacgttttaacgaacttttaactttaacgtaccgtataaccctaataacgttacttacgtaaccgtaccgggtcgtacggttaccggtacgggtcgtaacggggtacgtaagggtacccggtaaagttaaccggaacctagggtacnccggtgtcgtaacccg

SEQ ID NO: 215365 - DNA, 738 bp, Homo sapiens
  misc_feature: GYAE6OF01E43LX.1.34.D01.1.454.CMB.1.raw
  modified_base (178)..(178): a, c, t, g, unknown or other
  misc_feature (178)..(178): n is a, c, g, or t
  modified_base (345)..(345): a, c, t, g, unknown or other
  misc_feature (345)..(345): n is a, c, g, or t
  modified_base (458)..(458): a, c, t, g, unknown or other
  misc_feature (458)..(458): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggctcctgctgctctggcctcccgaggtaccagctgtgacactaccaattcgaccctagtccncctactccctcccgttgtctcgctacttcttagttggacacgagtacgtccacctattcctacggttcggacccggggacgtacggtccgacggccctagttccgaggtccgttactttttaccgttacggtccgtttggttcgacacggacgaacggtaaaccggngggaccacccgcccctagagtacgttcgtacgttcgtagtcggtacgcctacgtaccgtagtacgttacggacggtacggggtccggtacctacgtcggttagtcgagtcggntagctacgtaggtacggaggtaactactagtacctcgtctactatcgcgacgcgaacgctagccgtacgtcgttaagttacgtttacgttactaacgttttacgttaaccgttcgttaacgtaacgttaaacgtttacgtttaaccttaaccggttacccgttaacccggttaggttacccggggttacgtaccggggaccgggtaacggggtaaaccgttaggggtaccgtaaacggtaccggttaaccggtaggtaccggtcgtacgaccgttacccg

SEQ ID NO: 215366 - DNA, 532 bp, Homo sapiens
  misc_feature: GYAE6OF01C5NZT.1.34.D01.1.454.CMB.1.raw
  modified_base (101)..(101): a, c, t, g, unknown or other
  misc_feature (101)..(101): n is a, c, g, or t
  modified_base (114)..(114): a, c, t, g, unknown or other
  misc_feature (114)..(114): n is a, c, g, or t
  modified_base (266)..(266): a, c, t, g, unknown or other
  misc_feature (266)..(266): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (496)..(532): a, c, t, g, unknown or other
  misc_feature (496)..(532): n is a, c, g, or t
tcagacgagtgcgtcacgaccggtgctcgatttagatcgtctgtgttgggtttgggagtcaggccatcagcgattctttagcctggttgcagcagaaaccngggcgagcccctnagatcgtagtctagtggtgcaatccagtattgcaagggtcgggtcccatccaggttcaggtggcagtgcagtcgtagggacagtattacacgtctacactatcagcagtccctggcacgtctaggaacgttattttgactaaattttcttanacgtaccaatagttattaaccgtaccgtacccgtaggtacggtaccgttcggacgtaacgggggactaaagggtcggaacgtacccgaacgtagttgcggtaccttacggacctacctagttcgttcgtaccttacgaccttcccgttaccccggcttagtacccgtaaggaaccctcgtacgtttcgacggttgcgggcggttcnggtacgacgggcncgaagtntcgnnnnnnnnnnnnnnnnnnnnnnnnnnnnnnnnnnnnn

SEQ ID NO: 215367 - DNA, 833 bp, Homo sapiens
  misc_feature: GYAE6OF01ELPUM.1.34.D01.1.454.CMB.1.raw
tcagacgagtgcgtcacgaccggtgctcgatttagatcgtctgtgttgggtttgggagtcaggccctgtcaggacacagcatggacatgacgggtccccgctcagctccgtggggcctcctgctgctctggcctcccgaggtaccagctgtgactactaccaattcgaaccctagtcctaccactccctccctgtctgctatctagtggagacagatccacatcacgttcggccgggcgagtcgacggcctatcgagtcgttactttccgttacgtccgttagggttcacgaacgacgaaacggaaaacccggcggggacccgaaccgtccccctaggaacggtacgttaccggttaacgttacgtagtcgggtactacctacgtaccgaaggttacgttacgggaaccgggttaacggggggtcccggtaaccctacggttaccggtacggttccgtaacggtcggtcgaaggttcgaccgtttaacgtccgggtaagggtaacctaacgttaccttaacccaccgttacctaacgtaccgttaacgtccgtaacgccccgtaacggtccctacgccggtaacccgttaccgttaaggttaacggttttactttaccgtaaacttttaacgttttaaccgttaccggtaacgttaaaccgtaagtttaacgttacccgtttaaacccgttaaccccggggtaacccgttaagggttcccggggttaaaccccggtccgggaaaacccgggtaacggggtaacggtaaacgggtaacgggtaaccgtaaacccggtaacccgtagggttaccggtcgtacccgtcgtaacccg

SEQ ID NO: 215368 - DNA, 840 bp, Homo sapiens
  misc_feature: GYAE6OF01BF71X.1.34.D01.1.454.CMB.1.raw
  modified_base (567)..(567): a, c, t, g, unknown or other
  misc_feature (567)..(567): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctccaggtaccagctgtgacatccaattcgacccagtcctccactccctccctgtctgctatctagttggagacagacgtcacctatccgtacgttcggcccgggcgtaacgtcgacggcctaatccgagccgtattttccgtttacggtccgttgggttgaccacggaccgaaacggaaacccgacggggaccgaccgccccgtacgacggttacgttccggtaacgtttaccgtaaggtcgggtcgtacctaacgttaccgtaagtacggtttcggaccgggtaaacgggggttccgggtacccctacgttaaccggtacggtttacgacgggttcggtaactgggttacgccgttaacggttcgtacggggtaacctagttaacttaccgtaccttaccgtactaacgttactaccggtaacgaccggtaccnccggttacggaaccctacggtaccgttaggttaaacgtttattttaaccggtaactttaaacgttttacttaaccgtacgttaacgttaaacgttaacgttacgtttaaccgttaccggttaaccccgttaggggttacccggtaccgggtttacccggaaccggggttaaggggtaacccccggtaaaggggtacccggtaaaccggttaaccgggttaaaaccccgggtaggtttacccgggtacggttacccgggtcgtaaacccccggg

SEQ ID NO: 215369 - DNA, 819 bp, Homo sapiens
  misc_feature: GYAE6OF01D9736.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgacgggtccccnctcagctccgtggggctcctgctgctctggctcccaggtaccagctgtgacataccaattcgacccagtcctccactcctccctgtctgcatcttagttaggagaccagacgtaccacctattacctaccgttcggcccggggacgacgtcgacggcctagtcagtcttagtttcctttagtccgttggttcgacgtagaccgaacggaaaaccgcggggaccgtacccgacccctacgacggtacgttaccggttacgtcgtaaggtcgggtcactacgtaccgtagtacgtcggaaccggtacgggggtccggtacctactcggtacggttcggaaggtcggacgtacgtcgcgtacgtcgggacgggtaactacgtacgttaaccctacgtacctactacgttaaccgtacgaccgaccgtaccgaccgtaccggtaccgtaacgtccgttaagttaacgtttatttacccgttaagtttaaacggttttaccttaacgttaactaaccgttaaacgtttaacgtttaacgtttaacccgttaccgtttaaacccccgggttagggtaaacccgggttacccggtttaccccggggtaacccggggtaaaccgggggtaaccggttaaacggggggtaaacggtaaaccccggtttaaacccgggtaaacggttaaccggttagggcccggttaaccgtaccgggttaaacccc

SEQ ID NO: 215370 - DNA, 735 bp, Homo sapiens
  misc_feature: GYAE6OF01CUCJ3.1.34.D01.1.454.CMB.1.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (510)..(510): a, c, t, g, unknown or other
  misc_feature (510)..(510): n is a, c, g, or t
  modified_base (675)..(675): a, c, t, g, unknown or other
  misc_feature (675)..(675): n is a, c, g, or t
tcagacgagtgcgtcacgaccggtgctcgatttagatcgtctgtgttggggtttgggggagtcagaccctgtcaggacacagcatggacatgacgggtccccgctcagctccgtgggcctcctgctgctctggcctcccgaggtaccagctgtagacataccaattcgaccagtctccactcctcctgtctgcatctagtggaagtacagtacgtcaccatcacgttcggccggacgacgtcgacgccatcagcgtnttacttacgctcggtncgacgacgaaacggaaaccgcggggtccgaaccgtccccagaacgtacttaccggtaaggtttccgtaaggttgggttaccgacttaacgtacccgtaagtgttacggaacggttaaacggggtccgggtaacccctaagttacccgggtaggttaccgaggtacgacgtacggtactacgtaggtcgacgggaactaacgttaactaccgtacctacgttacgaacttagaccganaaccggtacgtcccgtaagcgtaaaccgtcggtaaaccggttaagttttaacttacccgggttaattttaaacgttttaaccgtacgttaaacggttctaaacgttaacttaacggttacccgtaacgttacccgtaggggtaccgttcggtacggggaaaccgngggtaaacgacggggtaagtacccgaaccggtactaacggttggtaacgtcgtcgaaacg

SEQ ID NO: 215371 - DNA, 768 bp, Homo sapiens
  misc_feature: GYAE6OF01A9A7P.1.34.D01.1.454.CMB.1.raw
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcactctattggagacaggacgtcaccatcacttggccgggctagtcaggccatcagcgtattcttagcctggttgcagcacgaaccgngggcacgcccctnagtatcgtagtctagtggcgcatccagtgttgacgtaagggtcgggtacccagtccgtaggttacgaggtcggactaggtcgactagtcggagggacaacggttacttaccgaccttcctactaaccgttacgtccgtaacggccgtaaccggtccccgtacggtacccgtaaccggttacccgttaacgggttaaaacggttacgttttttaccgaaaccttttaaaacgttttttaaccgtttaacgtttacgggtaaccttaaaaccggtttaagtttaaacgttaacccgttaaacccgggtttaccccccggttagggggtttaaacccgggttaacccgggtttaccccggggtaacccggggtaaagggggttaaccccggtaaagggggttacccgggtaaaacccgtaacccgggtaaaacccgggttaacccggttgggtaccccggggttaccgtcccggtaaaccccg

SEQ ID NO: 215372 - DNA, 1021 bp, Homo sapiens
  misc_feature: GYAE6OF01BV38G.1.34.D01.1.454.CMB.1.raw
  modified_base (964)..(964): a, c, t, g, unknown or other
  misc_feature (964)..(964): n is a, c, g, or t
tcagacgagtgcgtcacgaccggtgctcgatttagatcgtctgtgttgggggtttggggagtcacgaccctgtcaggacacgagctatggacatggacgggtccccgctcagctccgtggggctcctgctgcgtcgtggcctcccgaggtacctgtgtgtgactatacctaagttccgaccctagttcctaccacttccccttcccgttgtccgtgccgtagttcgttagttacgggacgaactaggtacgtacccaaccgtacttccgtaccggttccgggcccggggtacgtaggtaccgaccggaccctagttaccggaacgttaccgtttacttttccgttttacggtcccgtttgggttcgaccgaacgaccgaaacggaaaaccccggtcggggtacccgacccgtacccccgtagtaacggtacggtttaaccggttaggttcgttaaggttcggtaccgacttccgtaccgtagtacggttacggtaaccggtaggggttacccgggtcctaaccgtttcccgggttaaggttaccgtagggttaccggtacggtaacggtttacccggaccgttaacgggttaccgggttaaccggggtaaaccttaacggtacccttttaaacccggtaccccttaaccgtttaaccccgtaaaacttttaacccccggtacggaaacccctaacgggttacccgtttacccgggttaacgttacccgggtaacgtttaaccccgtttaaagggtttaaacgttttttacccgtttaaagtaactttttaaaccgttttaaccgtttaccgggttaaaccgttaacccggttaaaagttttcccgtttaaacgtttacccgttaaaaccccggtttaccgggttaacggggtttacccggggtaccgggtaccggggtaaaccccgggtacggggtaaacggtttaaggacccgggttaaaacncccccggttaaagggttacccggtttgggaaccccggtcggttaacccggtaacccg

SEQ ID NO: 215373 - DNA, 621 bp, Homo sapiens
  misc_feature: GYAE6OF01B8HZP.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccagctgtgacatccaattcgacccagtctccatcctccctgtctgcatctattggagacagagtcaccatccacttggccgggcgagtcaggccatcagcgtattctttagcctggttgcagcagaaaccgagggcgacgcccctnagactcgtagtctagtggtgcatccagtacttggacgtaaggggtcgggtacccctaagtcccgaggtttcaggttggaccgtaggttcgacgtacgttcgtaggggaacctaaggtaactttaccaccttcctacctaactatccagcctacgcctacgccgtacgccgtagtaagtacttttagacttaagttttattaccgtagttacaaactagttaactttacgtaaccgttacccctaggtcggtaaccgttccgggaccgtaaggggaccgtaaagggtcggtaaacgttacccgaaacccgtacgttacgggtcggtccgtgtacccg

SEQ ID NO: 215374 - DNA, 481 bp, Homo sapiens
  misc_feature: GYAE6OF01AQHN7.1.34.D01.1.454.CMB.1.raw
  modified_base (114)..(114): a, c, t, g, unknown or other
  misc_feature (114)..(114): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (453)..(481): a, c, t, g, unknown or other
  misc_feature (453)..(481): n is a, c, g, or t
tcagacgagtgcgtcacgaccggtgctcgatttagatcgtctgtgttgggtttgggagtcaggccatcagcgattctttagcctggttgcagcagaaaccagggcgagcccctnagatcgtagtctatggtgcatccagattgcaagggtggggtcccatccaggttcagtggcagtgcatcgtgggacagtattacactctcactntcagcagcctgcagcctagtaagttnttttagacttaattttacttactgtacaaactagttaattacgtaccgtaccccgttaggtcggtaccggttccgaccggacgggggtaacaagggtcggaacgtacgaaccggagtggtgcctagccacctntctcgtcttcacgttccctccccgccctctcgacnctcgtcgtctggcggcggtcgcggaacgtaggcctacaagtcgangtacncnnnnnnnnnnnnnnnnnnnnnnnnnnnnn

SEQ ID NO: 215375 - DNA, 622 bp, Homo sapiens
  misc_feature: GYAE6OF01BEQ2M.1.34.D01.1.454.CMB.1.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctccaggtaccagctgtgacatccaattgacccagtctccatcctcctgtctgcatctattggagacagagtcaccatcacttggccgggnagtcaggccatcagcgtattcttagcctggttcncagcaagaaccgngggcacgcccctnacgtactcgtagtctatggtncactcctagtacttggacgtaacggggtcgggtacccagtcccgaggttcgacggtggacgaggtcacgtagtcgtagggactagtacttacacttctacactactcgacgacgacgtccgtagacgtaccgtcgtaacgtaacgtttacttttacgtaactttaacgtttacttacgtacgttactaaacgttagttaactttaacgtaccggttaacccttacgggttacggtaccgttccgggaaccgaacggggtacgtaacggggtacgtaaacggtcccgtaaaacggtacgttacggacgtcgtcggtaaccc

SEQ ID NO: 215376 - DNA, 741 bp, Homo sapiens
  misc_feature: GYAE6OF01C8MM8.1.34.D01.1.454.CMB.1.raw
  modified_base (104)..(104): a, c, t, g, unknown or other
  misc_feature (104)..(104): n is a, c, g, or t
  modified_base (729)..(729): a, c, t, g, unknown or other
  misc_feature (729)..(729): n is a, c, g, or t
tcagacgagtgcgtcacgaccggtgctcgatttagatcgtctgtgttgggtttgggggagtcagaccctgtcaggacacagcatggacatggacgggtccccgntcagctccgtggggctcctgctgctctggcctcccgaggtaccagctgtgacataccaattcgaccctagtctccactcctcctgtctgctatctagtaggacacgtaggactaccaacctattaccgacgttcgggcccgggtacgtaggtccgaacgggccctagtaccggaagtaccggttaacttttccgtttaacggccgtttgggttacgacgaacgaaccgaaacggaaaacccggcggggaccgtaccccgtaccccgtacggtaacggtacgtttaaccgttaacggtacgtaggttcggtacgaccttacgtaccgaaggtacgttacgggacggtaacggggtccggtacctacgttacgtacggttcgaggtcgacgtgcgtacacgttcggaggaactatacgtacacttacactagtacgtacgacgtacgacgtccgtacgacgtagtaccgtaagttaacggttatttacgttaacctttaagtttaccgttagtacgtaactaacgttaatttaccgttaacgtacccgttaaccggttggtaccgggtacgtccgggaaacggtaggtaacgtaggtaacggacgtaacgtaaccggtataccgggngccgtagacccg

SEQ ID NO: 215377 - DNA, 801 bp, Homo sapiens
  misc_feature: GYAE6OF01CJTJC.1.34.D01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacataccaattcgacccagtcctccatccctccctgtctgctatctattgganacagagtccaacctatctacgttcggccgggcgagtcaggaccatcgagtcgtacttcgtttacgtccgttggttcgacgacgacgaacggaaaccgacgggaccgacgcccccgtacacgtacgttacggtacgtacttagtcgggtacgacgtacgtccgaagtacgttcggacggtaaacgggggttccgggtacccctagttacccgtaaggggtttacgaagggttcgggactagggttacgtacgtaacgttacgggtacggggaaactaagggtttaacctttaaccgtacccttaccgttaactaacccgttaacgttaccggaacgtaacccggtaacgttccccgtacggtacccgtaacggtacccgttaagggttaaacgtttacgtttttaacgaaccgttttaaactttttaacgtttaaccgttacgttaaacgtaaacctttaagtttaacggtttaaccttaaacccggttaccccgtacgggttacggttacccgggttacgggaacccgggtaaggggaccgtaaagggtacgaacgttaacccgtaaacggtacgtacggttaggcccgtggtaaccc

SEQ ID NO: 215378 - DNA, 783 bp, Homo sapiens
  misc_feature: GYAE6OF01BQ4CI.1.34.D01.1.454.CMB.1.raw
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggggagtcagaccctgtcaggacacagcatggacatggagggtccccgctcagctcccgtggggctcctgctgctcgtggcctcccgacggtaccagtctgtgacataccgtaattacgaaccctagtcctaccactccctcctgtctcgctattcttagtaggagacctagacgtaccaacctatccgacgtttcggaccgggcgtacgtaccaacggccaagtacacggttacgtacttttacgttacggccgttaggttanaccgtagcgaaacggaaaccggcggggacctccggacccctagaacgtacttcggtaagtttacgacgttggtaccgtactaactacggtagttacgtacggaccggtaggggtttcccggactaccggtaccggttacggttacgacgggttaggccgttaggtaccgtcgttaacgtccgggtaggtaactacgtacttacgtacctacgttactacgtacctagtacgacgtaccgtactacggggggacacgtacgtaaggttaacgtttacgttaccgttaacgtttaactttacgttacgttacgttaaccgttaacttaacgttaactttaacccgttaacccgttaccggttaccgggttaccggtacgggtaccgggtaaccgggtaagggtaaccgggtaacggttaacggtaacggtaccgtacggtaacgagggttacgtacgtccgtacccg

SEQ ID NO: 215379 - DNA, 753 bp, Homo sapiens
  misc_feature: GYAE6OF01A7MW8.1.34.D01.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (336)..(336): a, c, t, g, unknown or other
  misc_feature (336)..(336): n is a, c, g, or t
  modified_base (511)..(511): a, c, t, g, unknown or other
  misc_feature (511)..(511): n is a, c, g, or t
  modified_base (573)..(573): a, c, t, g, unknown or other
  misc_feature (573)..(573): n is a, c, g, or t
tcagacgagtgcgtcacgaccggtgctcgatttagatcgtctgtgttgggtttgggggagtcagaccctgtcaggacacagcatggacatgagggtcccccgctcagctcctggggctcctgctgctctggcctcccaggtaccagctgtgacatccaattgacccagtcctccatccctccctgtctgcatctagttgganacagactcaccatcacttcggccgggnacgtcacggccaatcgagtctattcgtttacgccttggttcgacagaccgaagaaacccggacggggaccgaccgcccccgtcgaaacggtactacggttaacgttntaacggttcgggtacgtacctaacgtcccgtaaagttaccggttacggtaccggtaacggggggtttaccgggtccccaaacgttacccgttacgggttaccgtagggtcggtaacgtgggtacgaccgttaggttccgggtaagggaacttacggttaacttacctaacccttntaccctataccgtacaacgtccgtaccggcctacggaccgtaacggtacctagttaaagttnttttaaccgaattttaacttttaacgtaagttaccttaacctaagttaacttaacttacgttaacccgttaccccgttaaggtccggttaccgggttacgacccgggtaacgggtacgggtaacgggtaacgggtacctaacccgtaaacccggtaggttacgggtctcgtaggtacccg

SEQ ID NO: 215380 - DNA, 806 bp, Homo sapiens
  misc_feature: GYAE6OF01CLASH.1.34.D01.1.454.CMB.1.raw
  modified_base (106)..(106): a, c, t, g, unknown or other
  misc_feature (106)..(106): n is a, c, g, or t
  modified_base (271)..(271): a, c, t, g, unknown or other
  misc_feature (271)..(271): n is a, c, g, or t
  modified_base (533)..(533): a, c, t, g, unknown or other
  misc_feature (533)..(533): n is a, c, g, or t
  modified_base (607)..(607): a, c, t, g, unknown or other
  misc_feature (607)..(607): n is a, c, g, or t
  modified_base (796)..(796): a, c, t, g, unknown or other
  misc_feature (796)..(796): n is a, c, g, or t
tcagacgagtgcgtcacgaccggtgctcgatttagatcgtctgtgttgggtttgggggagtcaggaccctgtcaggacacagcagtggacatggacgggtccccgntcagctccgtgggctcctgctgctctgcctccgaggtaccagctagtgacactaccaattcggaccctagtcctcctactccctcctggttctcgactattacgtaggttagacgaaccgtaggacgtaccaacctacgttacctaccggttcgggacccggggngtaacggttaccgaaccgggtacctacgttacggacgttacccgttaaacgttttcgttttaaccggcccggtttgggttacccacggaaccgtacggaaaacccggtaaaccgggtacgggcccgaccgggaacccccttacgaaagtccgttacggttacgtcgtaacggtcggtacctataccgtacgaagttacgtcgggaccgggttaacggggtaccggtcccctaagggttcccggttagtacggtacggtacgngtacggtaccggtactaacggtacggtacgggtaactaacgttacttacgtaccttacggtaacctcgttaacncgtacacgggaccctcggtactccgtacgtacgtacggttaacgttagtttaacctaatttacgttacgttactaacggtactaatacgtttagaccgttaccgtacggttaccggtaggtacccggtacggtaccggagggtaacaccggggtaacgttaaacccgacgttacccgaggtcgtacggngtcggtaacc

SEQ ID NO: 215381 - DNA, 628 bp, Homo sapiens
  misc_feature: GYAE6OF01A7MCN.1.34.D01.1.454.CMB.1.raw
  modified_base (275)..(275): a, c, t, g, unknown or other
  misc_feature (275)..(275): n is a, c, g, or t
  modified_base (311)..(311): a, c, t, g, unknown or other
  misc_feature (311)..(311): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctatggagacagagtcaccatcacttggccgggcgagtcaggccatcagcgtattctttagccgtggttgcgagcaacgaaaccgnggggccacgccccctgagtatcgtagtctagtggtncatccagtattggacgaaggggttcgggtcccctagttcccgtagggttcagggttcggcgtaggtcgactacgttcgtacggggactaaggtacttaaccaccttctactaacttacncgacncgacgcctgaccncgtctaggtaagttattttcgaatttaattttacttacgtacgtaactaaattagttaattaacgtaacccggtacccgttaggttccggtacccggttaccgggaccggtaaggggaaccgtaaggggttacggtaacgtaccggtaaaccgtaccggttggtcggtcctcggtacccg

SEQ ID NO: 215382 - DNA, 794 bp, Homo sapiens
  misc_feature: GYAE6OF01C1ERX.1.34.D01.1.454.CMB.1.raw
  modified_base (105)..(105): a, c, t, g, unknown or other
  misc_feature (105)..(105): n is a, c, g, or t
  modified_base (638)..(638): a, c, t, g, unknown or other
  misc_feature (638)..(638): n is a, c, g, or t
tcagacgagtgcgtcacgaccggtgctcgatttagatcgtctgtgttggggtttgggggagtcacgaccctgtcaggacacagcatggacatggacgggtccccnctcagctccgtggggctccgtgctgtctcgtggcctacccgaaggtaccagtctagtacactactacctaagttccgacccgtactccctaccctaccttcccccttccgtgtccgtcgtactacttacgttaggttaggacgaactacggtacctaccaactcgtaccgtacggttccgggaccgggtagtacggtacccgacggtactaacgtacgacggttaccgtttacgtttaccggttacgccgggtttaggttacgacggaacgaaccggaaaccggaaccggggccggtacccggtacccgtaccccgtagaaccggttacgtttacggttacgtacgtacggttcggaacgtcttaacgtacgtaggtacggtaccggacgggtaccggggtccgtaacctacggttacgtcggtagtacggtagacgtacgtactacgtaggttacggaacggtacgtatacctctacgactaacgtaccgtaacgcctacggatccgacgtcgaacgtatacgtttaacgtntttacgtaactacgttttacgtacttactacttaactaacgttagttaaccgtaccggtacccgttagggttaccggtacgtacccgggacggtaaccgggtacggaagtcgggtaaacgtaccggaaccgtagtacggacgtcgacggttcaacg

SEQ ID NO: 215383 - DNA, 725 bp, Homo sapiens
  misc_feature: GYAE6OF01ELT7O.1.34.D01.1.454.CMB.1.raw
  modified_base (103)..(103): a, c, t, g, unknown or other
  misc_feature (103)..(103): n is a, c, g, or t
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (168)..(168): a, c, t, g, unknown or other
  misc_feature (168)..(168): n is a, c, g, or t
  modified_base (201)..(201): a, c, t, g, unknown or other
  misc_feature (201)..(201): n is a, c, g, or t
  modified_base (301)..(301): a, c, t, g, unknown or other
  misc_feature (301)..(301): n is a, c, g, or t
  modified_base (418)..(418): a, c, t, g, unknown or other
  misc_feature (418)..(418): n is a, c, g, or t
  modified_base (489)..(489): a, c, t, g, unknown or other
  misc_feature (489)..(489): n is a, c, g, or t
  modified_base (580)..(580): a, c, t, g, unknown or other
  misc_feature (580)..(580): n is a, c, g, or t
tcagacgagtgcgtcacgaccggtgctcgatttagatcgtctgtgttgggtttgggggagtcagaccctgtcaggacacagcagtggacatgagggtccccgntcagctcctggggcctcctgctgctctggctcccaggtaccngctgtnacatccaattcgacccngtctccatccctcctgtctcgcatcgtatgganacagtgtccacatctacgttcggccgggtcaggtccaggtccataccgagtcgttactttcgtttacgtccgttggttcgactacgacgaacgaaaccgngggaccgaccgtaccccgtagtacgaacgttcgttacggttctaaggtcgggtactccgaattaccgaagttgtacggaccggtaggggttcccggtcccaagttccgtaggttcgnggtcgactaggtcgactaggtcgtacggactaacgtcgttaacaccgtacttcgaaactttcacgacgtanacccgtccgtacgccgaccgtaccgttaaggtaacgtttacttttaccgaatttttaaccgtttaattacctacgttaactaaaccgtttntttaactttaccggtacccggtttaaccccgttaagggtaccgttaccgggttaccggaaccggtttaaacggggaactaaacggggtaacgtaaccggttaaaacccgtaccggtaacgttcggtaaccgccgttacgtacccg

SEQ ID NO: 215384 - DNA, 818 bp, Homo sapiens
  misc_feature: GYAE6OF01CRSZ3.1.34.D01.1.454.CMB.1.raw
  modified_base (102)..(102): a, c, t, g, unknown or other
  misc_feature (102)..(102): n is a, c, g, or t
  modified_base (295)..(295): a, c, t, g, unknown or other
  misc_feature (295)..(295): n is a, c, g, or t
tcagacgagtgcgtcacgaccggtgctcgatttagatcgtctgtgttgggtttgggggagtcagaccctgtcaggacacagcatggacatgagggtccccgntcagctccgtgggctcctgctgctctggctcccaggtaccagctgtgacataccaattcgacccagtctccatccctccctgtcctgctatctagtggagacagagtccaccatctacgttcggccgggacgagtcgacggacaataacggctatttcgttagtccgttggtgacacgacgaacggaaaccgngggccgaccgcccctagacgtactcggtagttctaggtcggtacgactacgtccgaagttcgtacggacggtaaggggtccggtaccctagtaccggttaggttacgaggtcggacgtaggtacgcgtaacgtcggacgggtaactaaggttaacctttaacgaccctttactaaccgtaacttacgtaccgtaacggtacccgtaacgtccccgtacgaccggtaaccggttacccgttaaaggttaacgttttaacgttttaacgtaaccgtttttaaagtttttccgtaaccgttacggttaaaacgttactttaaaacgggttttaacctttaaaccggttaccccggtttaacccgggtttaacgggtaccggggtttaaccccgggtaacccggggtaaccggggtaaacccggggtaaacgggttaaccggggttaaacggttaaacccggtaaacccgtaaaccgggttcggtttaaccggttaccgggaccttccggtaacccggttaacccgg

SEQ ID NO: 215385 - DNA, 560 bp, Homo sapiens
  misc_feature: GYAE6OF01EBLNR.1.34.D01.1.454.CMB.1.raw
  modified_base (99)..(99): a, c, t, g, unknown or other
  misc_feature (99)..(99): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (529)..(560): a, c, t, g, unknown or other
  misc_feature (529)..(560): n is a, c, g, or t
tcagacgagtgcgtcacgaccggtgctcgatttagatcgtctgtgttgggtttgggagtcaggccatcagcgattcttagcctggtgcagcagaaaccngggcgacgcccctcagatcgtagtctatggtgcatccagattgacgaagggtcgggtacccatccgtaggttcaggtggcagtgcatcgtggganaagtnttaccgacttcacgactatcacgacacgccgtgaccacgtccgtagtaagtctttttacgaacttttaaattttacgttacgtatacctaagtagttaacttaacgtaacgttaccccgtaagtcgggacgttccggacggaacgggaaccggtaggggtagtaaccggtccgaaaaccgtacgttgggacgtacgtacaccacgtaacttcggtttaactccggtttacctacgtttcccgttccccccgtccccttacctccggtaaccgccttacggtcccgtacggtggaccgcgggtacgtcggaacgacgtcccgattaagcgnnnnnnnnnnnnnnnnnnnnnnnnnnnnnnnn

SEQ ID NO: 215386 - DNA, 829 bp, Homo sapiens
  misc_feature: GYAE6OF01D1Z52.1.34.D01.1.454.CMB.1.raw
  modified_base (104)..(104): a, c, t, g, unknown or other
  misc_feature (104)..(104): n is a, c, g, or t
  modified_base (158)..(158): a, c, t, g, unknown or other
  misc_feature (158)..(158): n is a, c, g, or t
  modified_base (576)..(576): a, c, t, g, unknown or other
  misc_feature (576)..(576): n is a, c, g, or t
tcagacgagtgcgtcacgaccggtgctcgatttagatcgtctgtggttgggtttgggggagtcagaccctgtcaggacacagcatggacatgacgggtcccccntacagctccgtggggcctcctgctgctctggcctcccaggtaccagctgtgacntaccaattcgaaccctgtcctccactccctccctgtctgctatcttagtggaagtacaggtactaccaacctagtcctaacgttcgggacccggggcgtaaccgtcgaacggtcccaagtccgacggtaccttacttttaccgtttaacggcccgttggttccgacgtacgacgaaaacggaaaccccggacggggtaccccgtacccgacccccgttagaaggttaaccgtttacggtaacgtccgttaaggtcggtaccactaacctacgaagtcttaagggaccgtaacgggggtaccgtacccacgtacccgtagggttacgaggttggactaccgttgacgtaccgtacggtagggaaacctacggttaacttaccacccttactaccgtactaccgtacacgactcccgganaccgggtacgtaaacgtcggttaagtaaggtttactttcggtaaatttacgttttaaccttacgttaataaacgttaaattacgtttaacgtttaaccccggaaacccggttttaccccggtagggtttcccgggaaacccggtttaccccggggtaaacggggaacgggttaaacccgggttaaagggttaccccggtaaaagtcccccgaaaaggtttaccggttcgggtaacggccctaaccgggtaacc

SEQ ID NO: 215387 - DNA, 922 bp, Homo sapiens
  misc_feature: GYAE6OF01D64LZ.1.34.D01.1.454.CMB.1.raw
tcagacgagtgcgtcacgaccggtgctcgatttagatcgtctgtgttgggtttgggcatggacatgacgggtcccccgctcagcctccgtggggcctcctgctgctcgtggctcccgaggtaccagctgtagactactacctaattcggaccctatcctcccactccccttccctgtctgactacttacgttagtaggaacgacagtacgtccacctacgtcctaccggtcgggccgggtacgtacggtccgaaccggcctagtacgacggtacgtttacgttttaccgtttacggtccgttgggttcgaccgaacggaccgaaacggaaaccggcgggacccggacccgtaccccctaggaccgtagttaccggttagtacgtacggttcgggtacgacctacgtaccgttaaggttaccgttacggggaaccgggttaaccgggggttcccggtaaccctacggttacccggttagggttaccgtacgggtcgtagttacggtcgtaccggttaacggtccgggtaaggtaaccgttaacggtttaacccttacccggttaaccctttaccggttaaaccgtaacttaccggtacccggacggtacccggtacggttaacccgtcgaaccggttcgtaaacggttaacgggttaactttacgtttacgtaacttttaagtttcgtaacgtacgtaaccttaagttacgttttaacgtttaccgacccgttaacccggtagggttaccggtaccgggtccgggtaacggtaccgggtaacgggttaaccgtaaggggtaaccctaaaccgggtaaccgtttaccgggcggtaacccgttaggtaaccccggtcttaaacccttggggttttccttcccgtttaaccgtttacctccccccggtttacgtcccccggttaaa

SEQ ID NO: 215388 - DNA, 712 bp, Homo sapiens
  misc_feature: GYAE6OF01EY1TJ.1.34.D01.1.454.CMB.1.raw
  modified_base (172)..(172): a, c, t, g, unknown or other
  misc_feature (172)..(172): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctcctgtctgcatctagttgganacagacgtcaaccatcacgttggccgggcagtcaggccatcagcgtattcttagcctggtcncagcaagaaacgngggcagcccctnagactcgtatctagtggtgactatcctaagagttcggacgaaggggtcgggacctatcccgtagttcaggtgtcagtcncgtatcgtcggaanacgtattaccacttcgactacgtatcaacggctacgccttgactagtccgtaagtaaagtttcgtttacgaaccgtttaatttttaacttacggtacttaaacgtaacttaacgttaactttaacccgggtaacgtttaacccccgtaggggttaacgggtaccccgtttacggggaacccggttaacgggggtaaaccctaaagggggttaaccgggtaaaacgttaaaccccggttaaaacccggtaacggtttacgggtaacggggtacccttaggaaccctaaaccgtttacgttaaacccgttttcgggaaacccctttttacgtaaccggtttccccgttccccggtaaaaccc

SEQ ID NO: 215389 - DNA, 747 bp, Homo sapiens
  misc_feature: GYAE6OF01CH37L.1.34.D01.1.454.CMB.1.raw
  modified_base (391)..(391): a, c, t, g, unknown or other
  misc_feature (391)..(391): n is a, c, g, or t
tcagacgagtgcgtcacgaccggtgctcgatttagatcgtctgtgtttggggtttgggggagtcagaccctgtcaggacacagcatggacatggacgggtccccgctcagctccgtgggcctccgtgctgctcgtcggcctcccgaggtaccagtctagtgactactaccaattccgaccctacgtcctccctaccttccccttcccctgttcctcgtcctattcgttagttgggacacgagacgtaccaacctatcgtacgttcgggccgggacgcgtcgacggcagtccagtcgttactttcgtttacgtccgttggtcgacgtacgacgaacggaaacggcgggaccgacccgccccgtagacgtagttccgtagtcgtagtcggtcncgtactacgtatacgttaggaccgggtacggggttccggacctaacggttccggacggtttacacgggtcgaaccggtgtacggctacggtcggtacggacttaacgtaccttaccaactttccactactacgcgtacctacgccgttcgactaccggaccgttacgtacgtttaatttacgtttacgtactttaagttttaacttaaccgtagttaactaacttttaacgtttaacgttaccgtaacccgttacccggtttagggaccccggttacggtaaccggggtaccggaaacggggttaccgtaaagggacggtttaaaccgaccgtacggtaactgggctacgccgtac

SEQ ID NO: 215390 - DNA, 763 bp, Homo sapiens
  misc_feature: GYAE6OF01CFRCF.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctcctggggctcctgctgctctggctcccaggtaccagctgtgacatccaaattcgacccagtctccactcctcctgtctgcatctattggagacagacgtcaaccatcacgttcggaccgggtcgagtcgacggccatcgagtcgtactttcgttacgccgttggttgaccgtagacgtaacggaaaccgacgggccgacgcccctacgacgtacttcggtaagtcgtagtggtcgactacgtaccgagtacgttcgacgtaaggggtcgggtacccacgttccgtaggttcgaggttcggatacggtcacgtagttcgtacgggaactacgtaactttacctacttccgtaactaaccttagtccgaagtaccgtacgtccctagggaccaacgggttcttaaggggtaaacttttacgtttttaacggtaactttaaacgttttttaaccttaacggtacgtttaaaccgtaaaacgtttaagtttaaacctttaccggttaaccccgggttaaacccgtttaccggggttaccgggtaaccggttacccgggtaaccgggggtaaacgggtaaacccggttaggggtaaccgggttaaaccgtacccggtaaaccgttaacggttaccggtcgtaaccggttacgaccccg

SEQ ID NO: 215391 - DNA, 731 bp, Homo sapiens
  misc_feature: GYAE6OF01DNHB2.1.34.D01.1.454.CMB.1.raw
  modified_base (101)..(101): a, c, t, g, unknown or other
  misc_feature (101)..(101): n is a, c, g, or t
  modified_base (200)..(200): a, c, t, g, unknown or other
  misc_feature (200)..(200): n is a, c, g, or t
  modified_base (500)..(500): a, c, t, g, unknown or other
  misc_feature (500)..(500): n is a, c, g, or t
  modified_base (725)..(725): a, c, t, g, unknown or other
  misc_feature (725)..(725): n is a, c, g, or t
tcagacgagtgcgtcacgaccggtgctcgatttagatcgtctgtgttgggtttgggggagtcagaccctgtcaggacacagcatggacatgagggtccccntcagctccgtgggcctcctgctgctcgtcggcctcccgaggtaccagctgtgacatccaattcgacccagtctccatcctcctgtctgcatctatgganacagacgtccaacctatccacgttcggccgggacgacgtaccgagggacctagtccgaaggtcgttactttacgttacggtccgttagggttcgacgaggaaccgaaacgggaaaccgacggggtaccgaccgtacccccgtacgaacggtacgttacggttacgtacgtacgttagggtaccacctacgtaccgtaagtacgttcggaacggtacggggttccggtacctacgtaccgtaaggttcgtacggtcggacgtaggtcgactagtacggtagggacctaagttacttaaccncgttacctacgtaactacgacgtacgacacgtcctacgactacgaccttaaggtacttaacgtttataactttaacttttagtaccgtagttacctaaagtttactttaacgttaccgttaacccggtaccgtaacggggttaccggtacccggttacgggaaccgggtaacggggtaacgtacgggtacgtaaccgtaccgtaaacggtacgtacgacgtcgtntaaccg

SEQ ID NO: 215392 - DNA, 758 bp, Homo sapiens
  misc_feature: GYAE6OF01A89HL.1.34.D01.1.454.CMB.1.raw
  modified_base (105)..(105): a, c, t, g, unknown or other
  misc_feature (105)..(105): n is a, c, g, or t
  modified_base (340)..(340): a, c, t, g, unknown or other
  misc_feature (340)..(340): n is a, c, g, or t
  modified_base (377)..(377): a, c, t, g, unknown or other
  misc_feature (377)..(377): n is a, c, g, or t
  modified_base (570)..(570): a, c, t, g, unknown or other
  misc_feature (570)..(570): n is a, c, g, or t
tcagacgagtgcgtcacgaccggtgctcgatttagatcgtctgtgttggggtttgggggagtcgagaccctgtcaggacacagcatggacatggacgggtccccnctcacgctccgtggggtcctcctgctcgctcgtcggcctacccgacggtaccgacgcgttaggtcgaacactacctaacttccgaaccctagtcctacctaccttcccttccctgtcctgtctacgttcgttacgttaggaacgtacgagtacgtacccaacctacttcgtaccggttcgggccggtacgacgtcgacggccatcgacgtcttacgtttcgttcgtccgtggtcncgacgacgaacgaaccggcggaccaccgtccgtacgngtacgtaccgtagtgtacgtcggtacacgtactacgagttacgttacggaccggtaaccggggtccgttaccgacggttacccggttagtacggtacggtcggactacggttacgacgttacggtacggtacgggtactacgttaacccgttacgtacctaccgtaacttactacgcgacgtcgacggtaccngacgtaccgtactaagttacgttactttactaacgtttattacgttacgtagtaaccgttattaacgttacgttacccgtaaccgttaccgtcgggtaccgttaccgggcggtaacggggtacgtaagggttaacggtaccgtaaaccgaccgtaaaggcccggttaggacccggtctaacgggaccc

SEQ ID NO: 215393 - DNA, 942 bp, Homo sapiens
  misc_feature: GYAE6OF01ERGBD.1.34.D01.1.454.CMB.1.raw
tcagacgagtgcgtcacgaccggtgctcgatttagatcgtctgtgttggggtttgggggagtcagaccctgtcaggacacagcatggacatggacgggtccccgctcagctccgtggggccttcctgctgcttctcggcctcccgagggtaccagtctggtcgaactacttacctaaagttccggaaccctacggttcctaccctaccgtttcccccttccccttggtttcctacggtcctacttccgtttaacgttaggggaacgactaagtaccgtacctaaccctactaccgtaccggtttccggggcccggggtacggtaacggtaccgaccgggacctacgtaccgtaacggttaccgtttacgttttaccgttttaacggttccggtttacgggtttacgaaccgtaacgggaaaccgaaaaccggggaaaacccgggtaccgggggtacccggtaaccccggtacccccgttaaccggaacggttaaccggtttaccggtttaacggttaccgttaaggtcgggttactactacctaccggtaagttacgtacgggtaccggtacgggggtccggtaccgtacgttacggtacggttacggtaggtaccggtagtacgtcgtaacgtcggtacggtacggaacgtacgttacttaaccgtcttacctactaactacgaccgagtcccgagtccctggaccgtaccgtaacgtaagtttacggttacgtttacgttaactttaacgttttacgtagttaaccgtaacgttaaacgtttacgttaacgttaccggttaaccccgttaaccggttgggtaacccgggttacggtaaccgggccgggtaacgggttaaacccggggtaaggttaacccgggtaaacgttaacccgggtaaaccggtacggttacggtaccgccgttaaccggtaacccg

SEQ ID NO: 215394 - DNA, 477 bp, Homo sapiens
  misc_feature: GYAE6OF01C8F4Q.1.34.D01.1.454.CMB.1.raw
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (440)..(477): a, c, t, g, unknown or other
  misc_feature (440)..(477): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtgggtcccatccaggttcagtggcagtgcatcgtgggacagattacactctcactancagcagcctgcagctagaagnttttgactaatttattacngtcaanagttatatacgtaccccagtcggacgttcgccgaaggggacctaaagggtcgaaagtcaaaccgtacgtggtaggcagtcaaccctatctacggtctttacgacttccgttaccccgactactcgtacgaacgtctacttcggtcgagtacgccgggctaggcgaaggcgactaatagcngtnagcgnnnnnnnnnnnnnnnnnnnnnnnnnnnnnnnnnnnnnn

SEQ ID NO: 215395 - DNA, 765 bp, Homo sapiens
  misc_feature: GYAE6OF01DGYQJ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtcgacatccaattcgacccacgtccccactcctccctgtcctgctatctagttggagacgagacgtcaaccatcctacgttcggccgggcgacgtcgacggccatcacgcgttattccgttttagcccgttggttcgacgacggacaacggaaaaccgcgggggaccgaaccggtccccctagaacggtacgttaccggttacgtaccgttagtacggggttacgcctaacgttccgaagttagttcgaaccggtaacggggttccgggtacccctagttaccggtaacggtccgaagggttcggcgtacggtcgaccgtaacgttcggtacgggaactacggttaacctactaccgtactacccgtaataccgtacaacggtaccgtacgtaccgtcgacgtacgacccgttagtaacgtttcgttttacgaacttttaacggttttactacgtttaaccgtacgttaaaacctaggtttaacctttaaccgtacccgttaaccccggttacgggtaaccggttccggtaccgggtaaccgggtaacgggtaccggtaagggtacggtaaacggtacccaaaggttaacgttcgggtagcccgttcgaccgttacg

SEQ ID NO: 215396 - DNA, 1002 bp, Homo sapiens
  misc_feature: GYAE6OF01AK7IV.1.34.D01.1.454.CMB.1.raw
  modified_base (108)..(108): a, c, t, g, unknown or other
  misc_feature (108)..(108): n is a, c, g, or t
  modified_base (163)..(163): a, c, t, g, unknown or other
  misc_feature (163)..(163): n is a, c, g, or t
tcagacgagtgcgtcacgaccggtgctcgatttagatcgtctgtggttggggtttgggggagtcagaccctgtcaggacacagcagtggacatggacgggtcccccgntcagccttccgtggggcctcctgctcgctcgtcggcctccgaggtaccagctgtnactatacctaagttccgacctacgtacctcctaccttcccgtcccttggttctcgtaccttaacttcggttaacggtacggaacgacgtacgtactaccaacctacgtacgtacggtccgggaccgggtacgtacggtaccgacgtacctagtacgacggtacgttacgtttacgttacggtcgtaggttacgaccgaacgtacggaaacggtaccggggtacggacctacccggacccgtacgtacggtaccgtttaacggttcggttaaccgtaggttaccgggttaactaaaccgtacgttaccggttaaacgtacgggttttaaccgggaacgggttaaccgggggtttacccccggtaccttaacccggggtaacggttacgggtttaccggtacggggttacgaaccggtttacgaaccggtttaaccggtaacgttaccggggtaaccggtaacgtaaacgtttaaccgtaaccggtttcccttaacctaccggtaaccgttacgaacccggtaaccgtaccgtaccgtacggtacccgaacgggttaccgtaaaccggttttaatttaaggtttaccggttttaaaccgttacgttttaaaacttttacgacggttttaaaccccttaacggtttaaacgttaaaccgtttaaacgttaaccccgttcccgttaaacccgggttaccggggtttaacgttacccgggggttaccccggaacgggttaaacggggaacccgggttaaacgggtaccggtttaaaaaccccggtccggttaaacggggtacgtttaccggggtaaccctttaccgggtaccgttaaacccggg

SEQ ID NO: 215397 - DNA, 852 bp, Homo sapiens
  misc_feature: GYAE6OF01A0JT8.1.34.D01.1.454.CMB.1.raw
tcagacgagtgcgtcacgaccggtgctcgatttagatcgtctgtgttgggtttgggggagtcagaccctgtcaggacacagcatggacatgacgggtcccccgctcagctccgtggggctcctgctgctcgtggcctcccgaggtaccagctgtgacatacccaattcgacccagtcctccactccctccctgtctgctattcgtagttggaagacgagacgtccaaccataccgtacggttcggcccggggacgacgtacgacggaccagtaccgagtaccgtattttaccgtttaacgtcccgttgggttacgacggaacggaccgaaaccggtaaacccggacggggaccgaacccgtcccctacgaacgtacgttaccggtaacggttcttaacggttcgggtacactaaccgtaccgtaaggttacgttagggaaccgggtaaacggggggttcccgggttaccccgtaaaccgttacccgggtaacgggtttaccgtaacggggtcggaccggttaggtaccgtccggttaaaacgttccggggtaacgggtaacttaaaccggttactttaacccgtaccttacgtacccgtaacttaacgtaccgacggtacccgaaccgtccgtacggaaccgtagtacccggttaaggttaacgtttacgtttaagtaacgtttaactttaccgttaactacgtaaccttaaacgttattaacttaaccgtaccgtaaccgttacggttacgggtaccggttacgggaccccgggttaagggaacggttaacgggtaacggtaaacccgttacggtaaaccggttacgtaggtacgtacccgtcgtaacccg

SEQ ID NO: 215398 - DNA, 905 bp, Homo sapiens
  misc_feature: GYAE6OF01A4YFK.1.34.D01.1.454.CMB.1.raw
  modified_base (104)..(104): a, c, t, g, unknown or other
  misc_feature (104)..(104): n is a, c, g, or t
  modified_base (153)..(153): a, c, t, g, unknown or other
  misc_feature (153)..(153): n is a, c, g, or t
tcagacgagtgcgtcacgaccggtgctcgatttagatcgtctgtggttggggtttgggggagtcagaccctgtcaggacacagcatggacatgacgggtccccnctcagctccgtaggggcctcctgctgctcgtcggcctcccgaggtaccnggtctgtagactactaccgtaattcggaccctagtcctacctacttccccttccgtggtctcgctacttcttaggtacggacaacgacgtacgtacctaactacttaccgtacggtcgggaccggggtacgtacggtacggaccggtacctaagtccgtacggttacgtttaaccgtttttaccgttacggtccggttgggttacgaccgaacggtaaccggaaaccgggaaacccggccggggtacccggtaaccccgtccgtacggtaacggttaccgtttaggttaccggtaggtttacggttacgggtctaccgtacgttaacgtaggttaccgttacgggaccgggttaccggggttaccgtacctacgtacgggtagttaccgaggtcgacgtagtcgactacgggtaggtacgtaagtacgttacgtacctaccgtactacccgttagtacctacggacgtaccgacgtcgaccgtcgtaaccgggttagtacggtttaatttaccggttaattaaccgtttaagtttaacccttaggtaccgttaacgtttaacgttacgttttaaccgtacccgtttaaacggggttaaccccgttaggggtacccgggttaaaccggggtacccgggttaaccggggttaacggggtaaaccggtaaacgggggttaacccttaaccgggttaaacccgggtaccggtttaccggggttaccgttacggtaacccgggtacttaaccccggg

SEQ ID NO: 215399 - DNA, 698 bp, Homo sapiens
  misc_feature: GYAE6OF01B4XIB.1.34.D01.1.454.CMB.1.raw
  modified_base (656)..(656): a, c, t, g, unknown or other
  misc_feature (656)..(656): n is a, c, g, or t
tcagacgagtgcgtcacgaccggtgctcgatttagatcgtctgtggttggggtttgggcatggacatggacgggtccccgctcagcctccgtggggctcctgctgcctctcggctcccgaggtaccagctgtgacactccaattcgacctacgtcctccactccctcctgtctgactatacgtagtggagacgagacgtaccaactacgttccgtacgttcggggccggggacacggtcacggaccatccaggtcttaacgtttcttcggccgttggtcgcgaaacgcgaaccgaaccggacgggaccgccgtaccctacgtagtacgttcggttacgtcgttagtggtacgacctacgtaccgtagtacgtacggacgggtaacgggttcccggacctacgttccggtaacgttcggtacggtcggcgttacgcgtagtacggttacgggacgggtaactacgttaactaccgtacttactacgtaactttcgaccgtacgaccgtccgcgttacgacgtacggtcgtaagttaattacttacgttactttaattacgtactaggtaactagttaatacctagtaacccgtacgtaggtacggccgtacgggaccgagggtacaggtacggaaccgtcgacgtacgtggtaccgnttacccgctctacgtcgtctccttacgccttaccgtcctacg

SEQ ID NO: 215400 - DNA, 903 bp, Homo sapiens
  misc_feature: GYAE6OF01CBKLQ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtcctccacttccctccctgtctgctattctagttggacgacagacgtccaaccaactcctacgttcggcccgggcggacgtcgacggcctatcgagtcgtatttccgtttacgccgttggttcgacacggacgaaacggaaacccggacggggtaccgacccgcccccgtagaacggtacgttaccggttacggttctaaggtcgggttcacgtacgtacccgaagtacgttacgggacggtaaccgggggttccgggtaccctacgttacccggtacggttcgtacgggtacggtacgtaggtacgtacgtacggtacggtacgggaactaacgttaaccgttacctaccgtttaccacttaaaccgttacgacccgaagtcccgacggtaccccgtgaacccgttaccgggacctttaaggtaaacgttttacttttaccgtaaacttttaaacgtttttaaccttaacggttaaccgttaaccgtaaaacgttttaaaccgggttattttaaaaccccggtttaacccccggggttaaacccccgtttaacgggggtttacccgggttaacccggggtttaaaccccgggggtaaaccgggggtaaaccccgggggtttaaaccctaaaaccggggggggtttaaccgttaaaaccccgggttaaccccgggttaaaacgggttacccgggtttacgggtccggttaaaccccggtcggtttaaacccccgg

SEQ ID NO: 215401 - DNA, 860 bp, Homo sapiens
  misc_feature: GYAE6OF01EIQPE.1.34.D01.1.454.CMB.1.raw
  modified_base (208)..(208): a, c, t, g, unknown or other
  misc_feature (208)..(208): n is a, c, g, or t
  modified_base (829)..(829): a, c, t, g, unknown or other
  misc_feature (829)..(829): n is a, c, g, or t
tcagacgagtgcgtcacgaccggtgctcgatttagatcgtctgtgttggggtttgggggagtcagaccctgtcaggacacagcatggacatgacgggtccccgctcagctccgtggggcctcctgctgctcgtcggctcccgaggtaccagctgtagacatccaattcgacccagtctccatcctccctgtctgcatcgtagttgganacagacgtaccaccattccgtacgttcgggccgggcgacgtcgacggacctagtacaggcgttaatttccgtttacggcccgttagggttcgaccgtaagggaccaaacggtaaaacccggacgggggtacccgaacccggtcccccctaagtaacggttaacgtttccgggttaagttaccgtttaagtacgggtacaacccgtaacgttacctaaggtaacggttacggtaccggttaaacggggggttcccgggttacccctaacgttaccccgggtagggtttacctaagggtacgggtaacctaacggttaccgagttacccggtaggggaaccttaaggtaacctttaaccacgttacctacgtaactacgttacaacgcgtacgtacccgtacgtaccgtacgtaccgtaacggtttaactttaggttttaacgtaacttttaaacggtttttactaccgttaacgtaacgtaaacgtttaagtttaaacgtttaacccgttaccccggttaacccgtaacgggttaccggggtaaacccgtttccgggaacccggttaaccggggtaaaagggttaaccggggtaaagtaacccggaacgttaaaccccgggngttacgggaccggtatccccggtacctaccg

SEQ ID NO: 215402 - DNA, 611 bp, Homo sapiens
  misc_feature: GYAE6OF01EQV33.1.34.D01.1.454.CMB.1.raw
  modified_base (570)..(570): a, c, t, g, unknown or other
  misc_feature (570)..(570): n is a, c, g, or t
  modified_base (572)..(573): a, c, t, g, unknown or other
  misc_feature (572)..(573): n is a, c, g, or t
  modified_base (575)..(575): a, c, t, g, unknown or other
  misc_feature (575)..(575): n is a, c, g, or t
  modified_base (577)..(611): a, c, t, g, unknown or other
  misc_feature (577)..(611): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtggggtcccatccgagttcagtgcagtgcatcgtgggacagtacttacactctcactatcagcacgtcctgcctacggacctaggtaacgtagtttttacaacttaatttttacttacgttagtaactaaaccgtaagttaatttaacctaaccgttaccccgtttacggtacggtaccgggttaccggaacccgggtaagggggaaacccgtaagggggttacgggtaaaaccggttacccgtaaacccggtaaacgttcggggtacggtacgtacgtacccaacccgttattccgttcgtttaccttacaccgtttccccgtccccgtactacgtacccgtaacggaaccgtcttacccgtacggttcgtacgggtcggaccgggtccgtaggaacggaaccggttgaactagtagacncnnangnnnnnnnnnnnnnnnnnnnnnnnnnnnnnnnnnnn

SEQ ID NO: 215403 - DNA, 748 bp, Homo sapiens
  misc_feature: GYAE6OF01AYH4T.1.34.D01.1.454.CMB.1.raw
  modified_base (103)..(103): a, c, t, g, unknown or other
  misc_feature (103)..(103): n is a, c, g, or t
  modified_base (327)..(327): a, c, t, g, unknown or other
  misc_feature (327)..(327): n is a, c, g, or t
  modified_base (470)..(470): a, c, t, g, unknown or other
  misc_feature (470)..(470): n is a, c, g, or t
tcagacgagtgcgtcacgaccggtgctcgatttagatcgtctgtgttggggtttgggggagtcagaccctgtcaggacacagcatggacatgacgggtccccnctcagctccgtggggctcctgctgcctctggcctcccgaggtaccagctggtacgacactaccaattcgacccagtcctccactccctccctgtctgctatctagttggaacacgagacgtaccacctatccacgttcgggccgggcgtagtacgaggccatcgagtccgtatttaccgttacgccgttagggttcgaccgaaggaaccaaacggaaacccggnggggacccgaccgtccccctaggaacgtcgttaccggttagtccgttaggtacgggtcgacttacgtaccgtaggtaacgttcggacgggtaacgggggttccggttaccccaggttacccgtagggttcgagggtcgaacgnggttcgacgtacggtacggagggtaactaagttaacctacgtaaccttcctacgtaaacctcgtaaccgacggaccgtaccggtcccgagtaacccgtaccggttaaccgtaacgtttaaaggtttcttttaaccggttaatttaacgtttttaactaccgtaacgttaacaatttacgttaattacccgtacccgtacggttacgttaccggacggttccggaacgggcggtaacgtagggtatacggtaccgtaacggtacgttggctctgtaccg

SEQ ID NO: 215404 - DNA, 897 bp, Homo sapiens
  misc_feature: GYAE6OF01B7Y8L.1.34.D01.1.454.CMB.1.raw
tcagacgagtgcgtcacgaccggtgctcgatttagatcgtctgtgttgggtttgggacgtcagaccctgtcaggacacagcagtggacatggacgggtccccgctcagctccgtgggcctcctgctgctcgtcggcctcccaggtaccagtctgtagactactcctaagttccgaccctagtcctccactcctcccgtgtctcgcctattccgtagtcggacgacacggtacgtaccaccgtaattccgtaacgtttcgggaccccggggtacgtaaacggttccgaacgggtcccctaagttaccgaacgggttccgttaaaccgtttttccggttttaaccggtcccgtttaggggttaccgtacggaacggtaaccgaaaacccgggtaaacccggtacggggaccccgaacccggttacccccgttacggaaacggttacgttaccggttaacccgttaggtttacggttacggtccgtaccgtaccttaaccggtagttaccgttaccggtaaccgggttagggggttacccccggttaccctaacgttacccggttacggtacgtcgggtacggtacgtacggtcgacgttagtcggtaaggtacgactttacggtactaccgtctaccgtacttacgacgtacggtcaccgtcctagaccgtacgtaccgttaagtactttacgtttaccgtaatttacccgtttagtaccgtacccgttaactaacgtttacgtttaacccgtacgtaccccggttaacccggttagggttaccccggtaaaccgggttcggggacccggtaaacggggttaacccggacgggttaacgtaaacccggttacggtaaaaccggttcggtaaccggtcggttaaaccgcccgtaacccgg

SEQ ID NO: 215405 - DNA, 504 bp, Homo sapiens
  misc_feature: GYAE6OF01CQKCN.1.34.D01.1.454.CMB.1.raw
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (470)..(504): a, c, t, g, unknown or other
  misc_feature (470)..(504): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatgggtgcatccagattgcaaggtggggtcccatccaggttcagtggcagtgcatcgtgggacagattacgactctcacttancagcagcctgcagcctagaagtattttgacttaaagttttactactgtacaactagtatttanacgtacccctagnggacgttcggcgtaggggacctagggtgaagtccaaaccgtactggtcggtacctggaccacctattcttcgttcctttaccatttccctccccggtacacgtttcctacgggaaacctccgaccttccggtccgtaggacggtccgggtcctagggaccgtaagggcctagtaatggntacngnnnnnnnnnnnnnnnnnnnnnnnnnnnnnnnnnnn

SEQ ID NO: 215406 - DNA, 700 bp, Homo sapiens
  misc_feature: GYAE6OF01AH8Q3.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagacgtccaccatcacttggccgggcgagtcacggccatcagcgtattctttagcctggttgcgagcaacgaaaccgagggcgacgcccctcacgatcgttagtctagtggtcgcactccagtagttcggacggtaacggggttccgggtaccctaacgttccgtaacggtttacgtaaggtcgggacgtaaggtcgaacgtaacgttccggtacggggtaacgtaacggttaacctttaaccaccgtttaccgttaaccgtaacgttaacgtaccgtacggaccgtaaccggtcccgttacgaccgtaacggtcccgttaagtaacgttttatttacggtaactttaagttttaacgtttacgttacgtaacctaacgttagtttaacttaacgttaacccgttacccgtaggttacgggtaaccgttcgggaccggtaacgggtacgtaacgggtacgtaacgtaacccgtaacggtacgtagtcggtcgtgtacccg

SEQ ID NO: 215407 - DNA, 712 bp, Homo sapiens
  misc_feature: GYAE6OF01BG2VJ.1.34.D01.1.454.CMB.1.raw
  modified_base (491)..(491): a, c, t, g, unknown or other
  misc_feature (491)..(491): n is a, c, g, or t
  modified_base (549)..(549): a, c, t, g, unknown or other
  misc_feature (549)..(549): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgcctctggcctcccgaggtaccagcgtgtgacactaccaattcgacccagtcctccactccctccctgtctgcatctagtgacacagacgtcacatcacgtcggccgggcgagtcgacggcactcggagcgttactttcgtttacggtccgtggttcgacgacgaccgaaacggaaaccggacgggaccaccggtaccccaggtacggtacgttaccggtacgttccgtaggtcggtagaccgtaccgttccgaagttacgttggaccggtaacggggttccggtaccctagtacccggtaagggttcgtaggtacggtaccgtaggtacgtacgtaggtccgtaagggtactaacgtacttaaccncgtactacgtactactacgacgtcgtacggcctggactacgtacgtaggtaacgtttnttacgttacttatttaagttacgttactaacgtagttaacgttaacttacgtaacccgttacccgggttacgttaccggtaccggtccggtaacggtaccgggaacggtacggtaacggtaaccgaacgtacccggaggttaccgtcggacgttcggtaaccc

SEQ ID NO: 215408 - DNA, 922 bp, Homo sapiens
  misc_feature: GYAE6OF01D4I76.1.34.D01.1.454.CMB.1.raw
  modified_base (103)..(103): a, c, t, g, unknown or other
  misc_feature (103)..(103): n is a, c, g, or t
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
tcagacgagtgcgtcacgaccggtgctcgatttagatcgtctgtgttgggtttgggggagtcagaccctgtcaggacacagcatggacatggacgggtccccnctcagctccgtgggcctcctgctgctcgtggcctcccgaggtaccngctgtanacatccaattcgaccctagtcctccactccctcctgtcnactattctagtggacacgagacgtaccaaccctataccgtaccggttcgggcccgggtacgacgtaccgacggaccctanacggaacgtccgttattttacccgtttacggtccgttggttacgacgaagaacccgtaaacggaaaaccgggcgggtaccccgacccgtcccctacggagttaacgttcggttacggtttacgtcggttcgggtacaccttaccgttaccggtagttaccgggtttacgggtaaccgggtaaccgggggttcccgggtaacccctaccggtttacggggttacggtacgtcgggttaaccgggtcgttaacgggcgtaacggttacggttacccgggtaagggttaaaaccgttacgttaaccctttacccggtttacctaaccgtttaacctaacccgttacggttaaacccgcccgtaaccggttcccgtacggtccggaaccgtcgggtttaacgtagttttaacggtttttacccttaggtttaaacctttttaccttttagttaaaccgtacgttaaccgtttaaacggttacttttaaccccgggtaaacccgttttcccgggttaaaccccggttggggtttcccccgggttaaaccgggtcccggggtaaaccgggtaacgggggtaaccggttaaagggtccccgaaacggttaacccgtacccggtaggtttcggggcttaaccgccgtaaccgggg

SEQ ID NO: 215409 - DNA, 1021 bp, Homo sapiens
  misc_feature: GYAE6OF01EQ6IK.1.34.D01.1.454.CMB.1.raw
  modified_base (1009)..(1009): a, c, t, g, unknown or other
  misc_feature (1009)..(1009): n is a, c, g, or t
tcagacgagtgcgtcacgaccggtgctcgatttagatcgtctgtgttggggtttggggggagtcacgaccctgtcgaggacacagcagtggacagtggaccggggtcccccgctccaggtccttccgtgggggtcccttccgtgctgccttcgtcggccctcccgacgggtacccagtcttggtcgaactactaccgtaagttccgaccctagttccctaccctacttccccttcccttggttcctcgacctacttacttaggttacgggaacgaccgtaaggtacgtaccctaacctaccttaccgtaccgttccggggcccgggtacggtacgtccgaccggtaccctacgacgtacggtaccttaacgtttaccgttttcggtcccgttagggttcgaccggtacgaaccggtaaaaccggaaacccgggacgggggaccccgtacccgtacccccgtacggtaaggtaaccgtttaccggttacgttaccgttagggtcgggtacactaacccgttacgtaacggttagtacggaacgggtaccggggttccgggtaccctacggtaccggttacggttacgagggtcgacgtaggtccgtagtaacggttcccggtaagggtaaccgtacgttaaacccgttacccttaaccgttaccccgtaacccgtttaaactttaccgaccgttaacccgggacctacccgggtaccgtccggtaacccggacggtttacccgtaagggtttaacgttttacggttttacctaaacgttttacgtttttaacggttaaacgttcggttaaaaccgttaacggtttaacgttttaaaccgtttaacccgtttaacccccgggtacccccgggtttaacgggtttacccggggttaaccccgggtaccggggtaacccgggtaaaccgggggttaacggtaaacggggttcccggtaaaaccccggtttaccgggtaaacccgttacgggttaccgtacggggttaaacccnccgggtaaaccc

SEQ ID NO: 215410 - DNA, 756 bp, Homo sapiens
  misc_feature: GYAE6OF01DHCIT.1.34.D01.1.454.CMB.1.raw
  modified_base (198)..(198): a, c, t, g, unknown or other
  misc_feature (198)..(198): n is a, c, g, or t
  modified_base (275)..(275): a, c, t, g, unknown or other
  misc_feature (275)..(275): n is a, c, g, or t
  modified_base (739)..(739): a, c, t, g, unknown or other
  misc_feature (739)..(739): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttcggaccggcagtcaggccatcagcgtatttcttacgcctggttgcagacaacgaaacgngggacgacgcccctacgagattcgtagtctagtggtgcactaccagtacgttgacgtaaacggggtcgggtacccctagtcccgtaagggtttccagggttacggacgtaaggtcgacgtagtacggttaggggaactacggtaattaaccgtacttacgtactaacttatacgaacgacgacggtccctggaccgtacgacccgttaggtaaagtttaacgtttttacgtaaccgtttaaatttttaacttttaaaccggttaacttaacgttaaaaccttaacgggtttaaaacttttaccgttaaacccggtttaacccccgtttaaacgggtaccgggttaaccggggttacccgggtaacccggggtaaacgggggtaaacccgggtaaaacggggttaaacggggtaaacccggttaaaccgtaaaacccgggttaaaccgttggggttaaacccggngtacccggtaaacccgg

SEQ ID NO: 215411 - DNA, 819 bp, Homo sapiens
  misc_feature: GYAE6OF01CKJ4M.1.34.D01.1.454.CMB.1.raw
  modified_base (293)..(293): a, c, t, g, unknown or other
  misc_feature (293)..(293): n is a, c, g, or t
  modified_base (382)..(382): a, c, t, g, unknown or other
  misc_feature (382)..(382): n is a, c, g, or t
  modified_base (570)..(570): a, c, t, g, unknown or other
  misc_feature (570)..(570): n is a, c, g, or t
tcagacgagtgcgtcacgaccggtgctcgatttagatcgtctgtgttgggtttgggggagtcagaccctgtcaggacacagcatggacatggacgggtccccgctcacgcctccgtggggccttccgtgctgctcgtcggcctcccgaggtacccagtcgtgtacgaccacttacctaagttccgaaccctcgttccctcctaccttccctcccgtgtctcgctacttctaggttcgaacgacgacgacgttccaaccgtacgtacctacggtcggccgggacgacggtaccnccggccagtccgaagttcgttactttaccgttacgcgttggtcgaccgaacgacgaaaccggaaaccggcggtaccgacccggtacccngtacgtacgttcggtaacttcgtacggtggacacgttacacgtaggtagtcggacggtaccgggtccgtcgtaacgtcggttacgtcgaggtcgacggtactcgacgttagtcgggtacggactaacgttacgtacctacgtcctaactacgtacgtaccgaccgtagttcccgaaccgtaccggtancccgggttaattaaacgggtaactttttacggtttaacctaagttttttactacgttaaacggttcctaaagttaaccgttaaacgggtttttaccaacccggttaccggttaaacgttcccgggttaaaccggggttacccgtaacggggttaacgggaaacccgggttaaacgggttacggggtaaaccctaaaccgttaacccgggtaaacttaacgggttagaccggtttcgccccgtttaacgg

SEQ ID NO: 215412 - DNA, 681 bp, Homo sapiens
  misc_feature: GYAE6OF01A4DB3.1.34.D01.1.454.CMB.1.raw
  modified_base (102)..(102): a, c, t, g, unknown or other
  misc_feature (102)..(102): n is a, c, g, or t
  modified_base (195)..(195): a, c, t, g, unknown or other
  misc_feature (195)..(195): n is a, c, g, or t
  modified_base (490)..(490): a, c, t, g, unknown or other
  misc_feature (490)..(490): n is a, c, g, or t
  modified_base (668)..(668): a, c, t, g, unknown or other
  misc_feature (668)..(668): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggctccaggtaccagctgtgacatccaattgacccagtctccatcctcctgtctgcatctattgganacagagtcaccatcacttcggccgggtcgagtcgacggccatacgagcgtacttcgtttacgtccgttaggttcgactacgacgaacggtaaaacccgaggggaccaaccgcccccgtacgaacgtacgtcggttagtacgtagttcgggtcactacgtacccgagtacgttacggacgtaacgggggttccggtaccccgtaacgttccggtacgggttacaacgggtcggtaccgtaggtcgcgtaacgtcggttacgggaactaagtacttaaccgtactctactacttacncgaacgtacgacgtcgtacgtaccgacgtacccgtagttaacgttagtttcgtaactttaagttttaacttacgttagtaaccgtaacgttacttaacgttacgtaacccgttaccgtaggttacggtaccgtcggtacggaacggtacggacggtacgtacgtaaccgacgttacgngtcgcgtcgtacg

SEQ ID NO: 215413 - DNA, 710 bp, Homo sapiens
  misc_feature: GYAE6OF01DCGR0.1.34.D01.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (696)..(696): a, c, t, g, unknown or other
  misc_feature (696)..(696): n is a, c, g, or t
tcagacgagtgcgtcacgaccggtgctcgatttagatcgtctgtggttggggtttgggggagtcagaccctgtcagtacacagcatggacatggacgggtccccgctcagcctccgtggggctcctgctgctcgtggcctcccaggtaccagtctgtgactataccaattcgaccctagtcctccactccctccctgtcncgactatctagtggaagacgaagacgttaaaccntacctacgttcggccgggacgtagacgacggaccaagtcgacggtacgtacttttcgtttacggccgttacgggttgaccgaacggtaaccaacgggaaaaccggccggggacccgaccggtaccccctagacgtacgttacgtagttacctagtcgggcactacgtccgtagtagttcggaacggtaaggggttcccgggacctacggtacgtagggttcgaggtcggtacacggtgtaccgtaacggtcgacgggtaaacgattaaccttactcctactacctaacgtaacgtacgacgactcgactcgactacgtaccgttagtaacggtttactttaaggtaacttaatttactaactacgtaactaactaagttacttaaccgtaccgtacccgtaggtacggtaccgggtacgtaacggtaacgggtacgaaggtaccgaagaaccgaaccgtagngtacgctcgatacc

SEQ ID NO: 215414 - DNA, 806 bp, Homo sapiens
  misc_feature: GYAE6OF01AGIBZ.1.34.D01.1.454.CMB.1.raw
tcagacgagtgcgtcacgaccggtgctcgatttagatcgtctgtgttggggtttgggggagtcagaccctgtcaggacacagcatggacatggacgggtccccgctcagctccgtggggctcctgctgctctggcctcccaggtaccagctgtgacactcctaattcgaccctagtcctccactccctccctgtctgctatctagtggacgacagagtccacctatcctacggttcgggccggggacgtacggtccgacgggaccctactaccgacggtaccggtttaacgtttccgttttaaccggccccggttttggggttacgacccgtaaacgggaacccggtaaaaccgggaaaaccccggggtacgggggaccccgtaccccggtacccccctttaacggaacgtacggtttaccggttacggttacgttaacggttcggggtaccacgtaccgttaccgtaagggtacgtttacgggaaccgggttaacggggggtcccgggttaacccctaacgggtttcccggttaaggggttaccgacgggttacgggaccgttagggtcccgacgttacggtacgggacgggtaactaacgttaacgttacctaccgttacctacgtaacttacgtaaccgtcggaccgtacgtacgtcggactaccgtagtaacgtaatttacgttactaatttaaccgtttgtacctagtaacctagttaattacgtacgtacctacggtccgtaggtccgtacggaccggtaggaacgtggtacctacgacgttaacggctggctgctaccg

SEQ ID NO: 215415 - DNA, 814 bp, Homo sapiens
  misc_feature: GYAE6OF01AJ0RL.1.34.D01.1.454.CMB.1.raw
  modified_base (102)..(102): a, c, t, g, unknown or other
  misc_feature (102)..(102): n is a, c, g, or t
  modified_base (215)..(215): a, c, t, g, unknown or other
  misc_feature (215)..(215): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggcctccaggtaccagctgtgacactccaattcgaccctagtctccatccctccctgtctgctatctagttggagacagactcaaccntccacgttcggccgggactacgtcaaggcctatacgagtaccgttactttacctttacggcccgttgggttacgacctaggacaacggtaaaccggcggggccgaccgtccccctagagtacgttacggttacggtaccttaggtcgggtactacctacgttacccgaaggttctttaaccgggaccgttaacggggggtttcccggtaccccttaagtttcccgggtaacggtttaccgtaggtttcgccttaagggtcctaccggttaagttccgggtacgggtaactaacggttacttaccgtaccgttcctacggtaacttacgtacggaacgtccgtacgtaccggttcgaaccgtaccgtttaccgtaagtttagtttaccgttactaacgtttaattttaccgtacgttactacgtaaacgtttcgttaagtttacccgaaccgttacccggttaggtttacccgggtaaccgggtttcccggacccggggtaaacgggggttaaacccggtgggtttaaccgggttaaccgtaaccccgggttaaacgggttcgtttacccggggccgggtaactttccgggtaaaccccg

SEQ ID NO: 215416 - DNA, 810 bp, Homo sapiens
  misc_feature: GYAE6OF01CAX4B.1.34.D01.1.454.CMB.1.raw
  modified_base (103)..(103): a, c, t, g, unknown or other
  misc_feature (103)..(103): n is a, c, g, or t
  modified_base (168)..(168): a, c, t, g, unknown or other
  misc_feature (168)..(168): n is a, c, g, or t
tcagacgagtgcgtcacgaccggtgctcgatttagatcgtctgtggttgggtttgggggagtcagaccctgtcaggacacagcatggacatgagggtccccgntcagctccgtgggctcctgctgctcgtggctcccgaggtaccagctgtgacatccgaatcgaccngtcctccatccctcctgtctgctattctagttggagaccgagtacgtaccacctactccgtacgttcggacccgggcgacggtcgaacggacccagttacgacggtccgttactttaccgtttaacggccgttgggttaccgaccgaaggaccaaacgggaaaacccggtacggggtacccgaaccgtaccccccgtttaggaacggtacgttaccggttaaacggttccgttaaggttagggtcgaccctaacgttcccgaaggttagtttacggaacggttaagggggttcccgggtacccctaggtacccggtaaggtttcgacgggtacgggctaacgggtctaccgtagtcggtacgggaactaacggtacttaacccacgttactaccgtactactacgacgtacgtaacggtcccaagtccgacgtaccgttaaggttaacctttagttttacgtaactttaacgtttacgtttacctaaggttaacccttaaagttacgtttaacttaaccgttaccccggttaaccgtaccgggtacggttaccggttaccgggaaccgggtaacgggtacggtaacggggttacggaaccgtaacccgtaaacggttcgtagggcgtaccgttcggaacccc

SEQ ID NO: 215417 - DNA, 656 bp, Homo sapiens
  misc_feature: GYAE6OF01BDTIU.1.34.D01.1.454.CMB.1.raw
  modified_base (141)..(141): a, c, t, g, unknown or other
  misc_feature (141)..(141): n is a, c, g, or t
  modified_base (200)..(200): a, c, t, g, unknown or other
  misc_feature (200)..(200): n is a, c, g, or t
  modified_base (615)..(615): a, c, t, g, unknown or other
  misc_feature (615)..(615): n is a, c, g, or t
  modified_base (625)..(625): a, c, t, g, unknown or other
  misc_feature (625)..(625): n is a, c, g, or t
  modified_base (641)..(641): a, c, t, g, unknown or other
  misc_feature (641)..(641): n is a, c, g, or t
tcagacgagtgcgtcacgaccggtgctcgatttagatcgtctgtgttgggtttgggcatggacatgagggtccccgctcagctccgtggggctcctgctgctctggctcccaggtaccagctgtgacatccaattcgaccngtctccatccctccctgtctgcatctatggagacagacgtcaccatccagtcgccgggnagtcagccatcagcgtattctttagccgtggttcgcagacaacgaaaccgaggacgaccgccctcagacgtcgtagtacctagtgggtcacgtatccgaagtacgttcggagtacgggtaccgggtacccagtaccctagggttaccagggtcggaacgcgttacgacgtacgtacgtacgggaacaggtaactaacacttacctacctaacttaactcaacgtacgaacggtccctacggacgtaaccgtaccgtagttaaacggttaatttaacgtaacgttaaacttttaagttaactaacggttaacaaaccttaacgtttaactacgtttaccggtaacccgttactacggtcggtaccgtaccgggacggaacgtacggaaggaacgttaaccgacgtaacgtgcgtancgacctacgnttctacgtactaccgntaccgttcccgaacc

SEQ ID NO: 215418 - DNA, 937 bp, Homo sapiens
  misc_feature: GYAE6OF01E3MXV.1.34.D01.1.454.CMB.1.raw
  modified_base (103)..(103): a, c, t, g, unknown or other
  misc_feature (103)..(103): n is a, c, g, or t
  modified_base (144)..(144): a, c, t, g, unknown or other
  misc_feature (144)..(144): n is a, c, g, or t
tcagacgagtgcgtcacgaccggtgctcgatttagatcgtctgtgttgggtttgggggagtcagaccctgtcaggacacagcatggacatgacgggtccccgntcagctcctggggctcctgctgctctggctcccaggtaccngctgtgacatccaattcgacccagtctccattccctccctgtctcgctattcttaggtggacgacgaggacgtccaacctatccgaccgttcggcccgggtgaacgtccgacgggccctagtaccgagtccggtaacttttccgtttacggtcccttgggtttccgacgacggacaaaccggaaacccggtaggggacccgacccggtacccccgtacgaaaggtacgttaccggttacggttaccgtacgggtttgggttacgaccgtaacttacccggaggttaacgttaccgggtaaccgggtaaacgggggttcccgggggttaccccctaacgggttcccgttaacggggttttaccggtaacgggttacgggtacggttaacggttccggaaccggtttacggttaccgggttaacggggtaaaccgtaaacgtttaacccgttaaccccgttaaaacctttcccccgtaaacctttaacccgtttaagtacccgtaaccggtacccggtacccgggtttaccccgttaagaccccggttaccgtaaccccgtttaagggttaaacgtttttacggtttactaaaccgttttattttaaccgtttaccgtaaccgttaacttaaaacgttacgtttaaaccttaccgtaccccggttaaccgtaccggttaggtaccccggttaacgggtaaccgggtaacggggaaacgggttacgggttaaccggaaaccgggtttaaaccctaaaccggggttacgtaggggttcggtaccgtccgtaaccccg

SEQ ID NO: 215419 - DNA, 703 bp, Homo sapiens
  misc_feature: GYAE6OF01BT4MC.1.34.D01.1.454.CMB.1.raw
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (682)..(682): a, c, t, g, unknown or other
  misc_feature (682)..(682): n is a, c, g, or t
  modified_base (693)..(693): a, c, t, g, unknown or other
  misc_feature (693)..(693): n is a, c, g, or t
tcagacgagtgcgtcacgaccggtgctcgatttagatcgtctgtgttgggtttgggcatggacatggagggtccccgctcagctccgtggggctcctgctgctcgtcggctcccgaggtaccagctgtgacatccaattcgaccctgtctccactccctccgtgtctcgacattctaagtggagacagactaccacgactcacgttcggccgggacgagcgagtaccatcgagtcgtatttcgtagccgtggtncgagacgaaggaaaccgcgggaccgtacnccctagcgtagtccgttaggtctaggaggtnacctaacgctaagtgttaccgaggtaacggtccggacctacgttcggtgttagcgggtagaccttggccgtaagtacgtcggtacggataactaacgtttaccacgttactaccgtaagtacctggaactcgtaacgccgtaagtacgaccgtagtaagttaacgttagtactaactttaacgtttatacgtattaaaccgtagttaaacgtttacgtaacgttaacccggttcccgggtaagttacccgggtaccggttacggacccgggttaacgggaacggtaaggggtcctaaacgaacccgttaacggtacggttggacccggtatacccgacttaccggtactttcgtacggttacccttancccggtttacncccggtaacc

SEQ ID NO: 215420 - DNA, 776 bp, Homo sapiens
  misc_feature: GYAE6OF01CVSI6.1.34.D01.1.454.CMB.1.raw
  modified_base (101)..(101): a, c, t, g, unknown or other
  misc_feature (101)..(101): n is a, c, g, or t
  modified_base (137)..(137): a, c, t, g, unknown or other
  misc_feature (137)..(137): n is a, c, g, or t
  modified_base (179)..(179): a, c, t, g, unknown or other
  misc_feature (179)..(179): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggatcagaccctgcaggacacagcatggacatggacgggtccccntcagctcgtgggctctgctgtctggctccgagaccngctgtgacataccaatcgaccagtctacactcctcctgtacngactatctagtgacgacagactacaactacttcacggttcggccgggatagtacgaacggacctaagtcgacgggtactacgtttacgtttacgcggttagtcgacagacgaaacgaacgcggacaccggcctanagtaatcgtatacgagtcggtanctaacncgagtacgtacggacggaacgggtccgtaccgacgttacggtaggttacgaagggtcgacgtaggtagtacncgttaagacgggaaactaggtacttacgaccttacaataaccgttagacccgaacggttccgaacgtttacggaacccgagggaaactttacccgggaaaggttaaacctttgggttttaacgaaaccctttttaaagtttccggttaaacacggttttaaaccgaaacgtttaaagtttaacgttaaaccgttacccccggggttaaccggttacggttaaacggggtaccccgggttaccgggaaaaccgggggtttaaaacccggggaaggtttaaacccggtaacggggtaaaaccgttaaacccgggaaaccggttacgggttcgtaaaccgggtcctttaggaacccctaaacgg

SEQ ID NO: 215421 - DNA, 784 bp, Homo sapiens
  misc_feature: GYAE6OF01A0DE8.1.34.D01.1.454.CMB.1.raw
  modified_base (171)..(171): a, c, t, g, unknown or other
  misc_feature (171)..(171): n is a, c, g, or t
  modified_base (404)..(404): a, c, t, g, unknown or other
  misc_feature (404)..(404): n is a, c, g, or t
  modified_base (770)..(770): a, c, t, g, unknown or other
  misc_feature (770)..(770): n is a, c, g, or t
tcagacgagtgcgtcacgaccggtgctcgatttagatcgtctgtgttgggtttgggggagtcagaccctgtcaggacacagcatggacatgacgggtcccccgctcagctccgtggggctcctgctgctgtcggctcccgagtaccagctgtagacatccaattcgacccngtcctccacttccctccctgttctcgctattcgtagttggaagtacagactaccaccgattaccgtacgttcgggcccggacggtaactcgtaacggcctaagtccgaacggttcttactttcgtttacggtccgttcggttcgacgtacgaccgtaaacggaaacccggcgggaccgacccggtacccccgtagtacggtacgtttacggtaaccgtgtaacgttcgggtanaccgtacgtcctaaggttacgttcggaacgggtacgggtccgggaccttagtacccgtagttccgaaggttcggacgtaggtctacgtacgttaccggtagggtaacttacggtaactttaacccgacctttacgtaccttaactacgtaccgaacgccgtaaccggtcgttaaccgctaaccggtacgtttaacgttaccgttaagttttcgaaactttttaacccggtttattacccggtaacctttacgtaaaactttacgtttacgtaacccgtttaacccggtaccgttaacgggttaccgggttacgtacccggacggaaggttaaccggtagggtaccgtaactacgaacgtacgtagnggtaccgtgacccg

SEQ ID NO: 215422 - DNA, 693 bp, Homo sapiens
  misc_feature: GYAE6OF01D056B.1.34.D01.1.454.CMB.1.raw
  modified_base (203)..(203): a, c, t, g, unknown or other
  misc_feature (203)..(203): n is a, c, g, or t
  modified_base (681)..(681): a, c, t, g, unknown or other
  misc_feature (681)..(681): n is a, c, g, or t
tcagacgagtgcgtcacgaccggtgctcgatttagatcgtctgtgttgggttgggggagtcagaccctgtcaggacacagcatggacatgagggtcccccgctcagctccgtggggctcctgctgctctggcctcccaggtaccagctgtgactatccaattcgacccagtcctccactccctcctgtctgctatctatgganacagagtcaccatcacgttcgccggacgagtcgaggccatcgacgcgtactttcctttacgtccgttggttgacagcaacgaaaccgcggggaccgaccgcccctcgaagtacgtcggtacgttctaagtgggtcacctactaccgtagtactttggaagtaacgggtcgggtccctagtcccgtaggttcaggtcggtcacggtcacgtacgtacggtggtaacgacgtacttaacctacctccgttactactaacgtcgaacgtaccacgtcccgtagaccgtacgtacgttaagtaacggttattttacgtacgtttaaagttttacttactacgtaacttaaactatttaaacttaccgttaaccgttaccccggttaggtaccgggttaaccgggtaccgggtaccggtaacggggtaaccgtaaagggttacgggtaaaccgtaaccgtaaaccggtacgtggtaacgggtnccgggtaacccg

SEQ ID NO: 215423 - DNA, 628 bp, Homo sapiens
  misc_feature: GYAE6OF01B2NQ1.1.34.D01.1.454.CMB.1.raw
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (583)..(583): a, c, t, g, unknown or other
  misc_feature (583)..(583): n is a, c, g, or t
  modified_base (597)..(628): a, c, t, g, unknown or other
  misc_feature (597)..(628): n is a, c, g, or t
tcagacgagtgcgtcacgaccggtgctcgatttagatcgtctgtgttgggtttgggagtcaggccatcagcgattctttagcctgggttgcagcaagaaacccgaggggcgacgcccctcagattcgtagtctatggtgcatccagattgacgaagggtcggggtccctatccgtagggttcaggtgggcaggtcgctatccggtgggacagtacttaccactctacactancancgatctgacagccgaggtaattgttttntaacttaattttacttacgtcgttaacgaaatagttaattaaccgtaacctaccccgttaggtacggttaccggttccgggacccggtaaagggggtaccgtaaagggggttacggaaaccgtaaccggtaaaaccggtacggtttagggtacggtaccgtttacggacccgttaacccgttaattccgttacggtttacccgttaccgtttactccccgtttaccccgactcggttacccacggtaaacccgtcgtaccgttccggtaggtacgggacggcgggtaccggtagggaccgtagggaccgactagggaatnacgagctgctagcnnnnnnnnnnnnnnnnnnnnnnnnnnnnnnnn

SEQ ID NO: 215424 - DNA, 904 bp, Homo sapiens
  misc_feature: GYAE6OF01CN6J8.1.34.D01.1.454.CMB.1.raw
  modified_base (103)..(103): a, c, t, g, unknown or other
  misc_feature (103)..(103): n is a, c, g, or t
  modified_base (355)..(355): a, c, t, g, unknown or other
  misc_feature (355)..(355): n is a, c, g, or t
  modified_base (380)..(380): a, c, t, g, unknown or other
  misc_feature (380)..(380): n is a, c, g, or t
tcagacgagtgcgtcacgaccggtgctcgatttagatcgtctgtgttgggtttgggggagtcagaccctgtcaggacacagcatggacatgacgggtccccgntcagctccgtggggctcctgctgctcgtggcctcccgaggtaccagctggtacactactaccaattcgacccagtcctcctacttccctccctgtctgacacttactagttagggaacgacgaacgtagtaccaacctctacctaccgttcgggccgggtaagcgtacgacggcagtcgagtcgttactttcgttacgtcgtcggttcgacacggacaaacggaaccggacggggaccgaccgaccccgtanacggtacgttcggtacgtattaggnggacgtactacgttaccaggtcgttaacgggacggttaacggggtccgggtaccctacgtacgggttaacggttcgaacgggtcggtaccggtagtacggtacgtaacggttacccgggtaaggtaacgtacggtttaaaaccttaccccggacttttaacccggtttaacaaacccgtttaaggttacggggtaaacccacccgtaccggtacccgtaaaccggggaaccttaacccgggtttagtttaacggttttaactttcgtttttaaacgtttaaacgtttttaaacgttcccgttaacggttaaaccgtaaaccgttaacgttttaaacgtttaaccgggtttacccggtaaaaccccggttttaccggtttaccggggtaacccggggggttaccggttaaccgggtaaaccggggggttaaaccgggtaacgggttaaacggggttaaaaccggtaaccccgttaaccgggttaaacgggttacgggttccggaaccgttccggtaaaccaccgg

SEQ ID NO: 215425 - DNA, 945 bp, Homo sapiens
  misc_feature: GYAE6OF01BNL8B.1.34.D01.1.454.CMB.1.raw
  modified_base (212)..(212): a, c, t, g, unknown or other
  misc_feature (212)..(212): n is a, c, g, or t
tcagacgagtgcgtcacgaccggtgctcgatttagatcgtctgtgttgggtttgagggagtcagaccctgtcaggacacagcatggacatggacggtccccgctcagctccgtggggctcctgctgctcgtcggtcctcccgaggtaccagctgtgacactccaagtcgaccctagtcctaccactccctcctgtctgacattctagtgganacgagacgtcacctactactacggttcgggccgggtacgacgtacgacggtccacgtcgacggtccttacgtttcgtttacgccgttgggttacgacgtacggacgaaaaccggaacccggtacggggaccccgtaccgtacccccgtacgaacggttaccgtaaccgggttacgttaccgttaaaggtccgggttacgaccgtaccgttaaccgtaacggttacgttaaccggggtaacggttaaacccggggttccccggggtaacccgttacggttaacccggttaacggtttcccggtaaacggggtaaccgggtctaaacgggttcgggtaaccgttaccgggttacgggaaacgggttaacctaaggtttaacccgttaaaccgtaaccgtttaccgtaaacctaccggtttaactcccggaaaccgtttaccgggtaacccgttccggtaccggtaacccgtaacggtaccggttaacggtttaaagtttacgggttttaaacgtacctttttaaagttttaaacccgttaacggtttaccgtaaattaaaccggtttaaacgttacccttttaaaccggtaacccgtttaccccggttaagggttaaccccgggttcccgggtaaccgggttaacccggggacgggttaaaaccccggtagggtaaacccgggtaacggttaaacccggtaacgggttacgtaccggggtcgtaaccccggtacc

SEQ ID NO: 215426 - DNA, 705 bp, Homo sapiens
  misc_feature: GYAE6OF01CJELZ.1.34.D01.1.454.CMB.1.raw
  modified_base (200)..(200): a, c, t, g, unknown or other
  misc_feature (200)..(200): n is a, c, g, or t
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattgacccagtctccactccctccctgtctgcatctagtgganacagatccaccatcacgttcggccgggcgacgtcgacggccatcagcgtatttcgttagccgttggttncgagacaaggaaccgagggcgaccgcccctnacgatcgtagtctagtcggtgacactcgagtacgtggacgtacggggtcgggtaccagtccgtaggttcngggtcgacgtaggtcgacgtacgtcggtacgggaactagttaaccttaaccgtaccttccttaacctaacttaacgtacccgaggtacccacggtcctacggacctaccgtaccgtaaggtaaacgtttcgttttacgaaccttttaaagtttacgtttaccgtcgttaaacctaaagttacgtttaacgtttaaccgaaccccggtttacccgtcgggtttaaccgggtacccgggttacccgggaaccggggtaacgggtaaacggtaacgggggtaacggtaaacccgtaaccggtaaaccggttaggtacgggtactccgtaccgaacccg

SEQ ID NO: 215427 - DNA, 713 bp, Homo sapiens
  misc_feature: GYAE6OF01B470F.1.34.D01.1.454.CMB.1.raw
  modified_base (101)..(101): a, c, t, g, unknown or other
  misc_feature (101)..(101): n is a, c, g, or t
  modified_base (126)..(126): a, c, t, g, unknown or other
  misc_feature (126)..(126): n is a, c, g, or t
  modified_base (145)..(145): a, c, t, g, unknown or other
  misc_feature (145)..(145): n is a, c, g, or t
  modified_base (694)..(694): a, c, t, g, unknown or other
  misc_feature (694)..(694): n is a, c, g, or t
  modified_base (702)..(702): a, c, t, g, unknown or other
  misc_feature (702)..(702): n is a, c, g, or t
tcagacgagtgcgtcacgaccggtgctcgatttagatcgtctgtgttgggtttgggggagtcagaccctgtcaggacacagcatggacatgagggtccccnctcagctcctgggctcctgctgctntgctccagtccagctgtanacactccaaattcgaccctgtcctccactccctcctgtctgcattcgtattcggaagacagtacgtcaacctatccacgttccggccggggtcacgtccgaacgggtccaagttcgaagtccgtatttccgttacgccgttggttcgacgacgtacgaacggaaacccgtggggaccgaccgtaccccctagacgtacgtcgttacggtctagtggtcactacgtccgagtacgttacggaccggtaacggggttcggtaccctaacgtccgttaacggttcgtaaggtcggacgtacgttcgactacgtcggtaacgggtacttacggtaacgtttaccaacccgttacctacctaacgttaatccgaacgtctaccgtactaccgctacgtccttaagggtaaaccctttgtttaaacccgatttaaacggttttaacttactaggttaaaccaagtttacgttaactacgttaaccctacccgtaggttaccgtacggacggtacggtaacccgggtaaggtacgaacgtaactccgaaaccggtntacgggtntacggctaccg

SEQ ID NO: 215428 - DNA, 704 bp, Homo sapiens
  misc_feature: GYAE6OF01BLBLQ.1.34.D01.1.454.CMB.1.raw
  modified_base (293)..(293): a, c, t, g, unknown or other
  misc_feature (293)..(293): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccactccctccctgtctgcatctattggagacagagtcaccatcgacgttcgccgggacgagtccaggccatcgagcgtaatttcctttaggccgtaggttcgactagaccaaaggaaaaccgnggggaccgaccggtccccctacgaacgtacgtaccggttacgttacgtaaggtcgggtacgccgtaacttacccgaaggttacgttaggaccggtaaacgggggttcccgggggtaacccctacgttacccggttaacggggttcctaaggggttcggacgtaacgggttcgaccttaaggttccggtaacggggtaactaacggttaacttaacccaccggtttactaccctaacgttacgtaaccacggactaccggtcctacgacctacgtcgtagtaaagttgtttacgtatttaacgttacttatgtacctaatattacttacgaccgttaccgtgtacggtacggttaccggacgtacggggaacttcggggagtaacgaccgtaacgtagtcggcggtctcgac

SEQ ID NO: 215429 - DNA, 949 bp, Homo sapiens
  misc_feature: GYAE6OF01DPB9J.1.34.D01.1.454.CMB.1.raw
  modified_base (105)..(105): a, c, t, g, unknown or other
  misc_feature (105)..(105): n is a, c, g, or t
tcagacgagtgcgtcacgaccggtgctcgatttagatcgtctgtggttgggttgggggagtcagaccctgtcaggacacagcatggacatggacgggtcccccgntcagcctccgtggggcctcctgctgctcgtggcctcccgaggtaccagctgtcgactactaccgtaattcgaccctagtcctaccactccctcctgtctgactatactagtggacactagatccaccactctactcgggaccgggcgacgtcgacggtaccataccgagtacgttactttaccgtttacggtcccgttagggttacgaccgtaaggaccgaaaccggtaaaaccgggacggggacccggtaacccggtccccccgtacgaacggtaactttaccggggtaccgtttacgtaccgggttacgggtcctaacctaacgtacccgtaaaggttacgttaaccgggtaaccggtaaccgggggggttcccgggttaaccccgtaaaccgttacccgggttaaaccggttcgggtaaacgggttcggtaccgtaagggtcgtaccgttaccgtacggggttaccggtacgtaacggttaaacctttacccctaaaccggtttacccttaaccgttaaacgttacccgtacggaaccgtacccggtaaccggttcccgttacgacccggttaaccgtacccggttaaggtttaaacccgttaaggtttttaccgtaaattttaacttttaacggtacgtttaacgtaccttaaacgggttaacctttaaaccttacccggttaaaccggttacccccgtttacggggtaaaccgggtttacccggtacccggggttaaacccgggaaggggtttaaacccgggggtaaacggttaacggggtaaaccctaaacccggggtaagtaccggtacggtttaacggccggtaactacccccggg

SEQ ID NO: 215430 - DNA, 877 bp, Homo sapiens
  misc_feature: GYAE6OF01C9KLF.1.34.D01.1.454.CMB.1.raw
  modified_base (202)..(202): a, c, t, g, unknown or other
  misc_feature (202)..(202): n is a, c, g, or t
  modified_base (683)..(683): a, c, t, g, unknown or other
  misc_feature (683)..(683): n is a, c, g, or t
  modified_base (867)..(867): a, c, t, g, unknown or other
  misc_feature (867)..(867): n is a, c, g, or t
tcagacgagtgcgtcacgaccggtgctcgatttagatcgtctgtgttggggtttgggggagtcagaccctgtcaggacacagcatggacatgacgggtccccgctcacgctccgtggggctcctgctgctctcgtctccaggtaccagctgtacgacactacctaacgttcgaccctacgtcctccacttccctcctcgtcncgactacttactagttcggaacgacgtaacggtactaccaacctacttaccgttaccggttaccgggggccggggaccggtaacgggttacccgacgggtaccctaagtaccgaacggtaaccggtttactttttacccggtttcgggtaccggttggggttacgaccgtaacgggtaaccggtaaaacgggaacccgggtaacggggaccgaaccccggtcccctaaccgtaagggtacctttaccggttaacgttacgtaacgggtcgtacgaccgttaacgtaccggttaaggtacggttacgggtaaccggggttaccgggggttaccgggttaacccctaccggtttaccgggtaacggggtttacgtacggggtacgggtaccggttacggttaaccggacgttacgggtttacccgggtaaggaacgttaacgttaaccgtttacctaaccgttcctaacgtaacttaggaacnccgtaccgtacgccgtaacgctacgtacttaagtactttgttacgtaactttagtactttacgataacttaagtactttacgtaccgtaaccggtcgttacgggtaacgttccggaaccggggtacgggtaacggtaacggtagggtaaccggtacctaacgtacgggttacacgggtttcggntcccggtaac

SEQ ID NO: 215431 - DNA, 725 bp, Homo sapiens
  misc_feature: GYAE6OF01A31U4.1.34.D01.1.454.CMB.1.raw
  modified_base (105)..(105): a, c, t, g, unknown or other
  misc_feature (105)..(105): n is a, c, g, or t
  modified_base (157)..(157): a, c, t, g, unknown or other
  misc_feature (157)..(157): n is a, c, g, or t
  modified_base (513)..(513): a, c, t, g, unknown or other
  misc_feature (513)..(513): n is a, c, g, or t
  modified_base (571)..(571): a, c, t, g, unknown or other
  misc_feature (571)..(571): n is a, c, g, or t
  modified_base (707)..(707): a, c, t, g, unknown or other
  misc_feature (707)..(707): n is a, c, g, or t
  modified_base (716)..(716): a, c, t, g, unknown or other
  misc_feature (716)..(716): n is a, c, g, or t
tcagacgagtgcgtcacgaccggtgctcgatttagatcgtctgtgttgggtttgggggagtcagaccctgtcaggacacagcatggacatggacgggtcccccgntcacgctccgtggggcctcctgctgctcgtgcctcccgaggtaccagctgtnacactaccaattcgacctagtctacctctcccttcctgtctgactacttcgtagtaggacgacagtactccaaccgtactcgttaccggtcggcccgggggtacgacgttaccggaccggtacctacgtacgtacggtaccgttaccgttttaccgtttaccggtcgttacgggttcgaacccgaggtaaccgaaaccggaaaccgggccgggtaaccccgacccgtaccccgtagacgttacgttaccggtaacgttcgtagtcggtaccacgttacgtacgtaagttcgttacggacggtaacggggtttccggaccgtacttaaccgggtgtacgacgggtagtcgtggtacncgtacgtcggaggtacaacgttacgacttacgtctaacgttacacgtacgacgtccgngtcacgtcggtatccgtaattacgttatttaccgtaatttccgttacgtactacgtataaccttagtaaccgttacctaaccgttacgtacggtgacccggttaggaccggagtaggacgtacgacggacgtacgngtaccggtncgtacgtcg

SEQ ID NO: 215432 - DNA, 636 bp, Homo sapiens
  misc_feature: GYAE6OF01A6Q1L.1.34.D01.1.454.CMB.1.raw
  modified_base (187)..(187): a, c, t, g, unknown or other
  misc_feature (187)..(187): n is a, c, g, or t
  modified_base (219)..(219): a, c, t, g, unknown or other
  misc_feature (219)..(219): n is a, c, g, or t
  modified_base (250)..(250): a, c, t, g, unknown or other
  misc_feature (250)..(250): n is a, c, g, or t
  modified_base (482)..(482): a, c, t, g, unknown or other
  misc_feature (482)..(482): n is a, c, g, or t
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
  modified_base (597)..(597): a, c, t, g, unknown or other
  misc_feature (597)..(597): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (632)..(632): a, c, t, g, unknown or other
  misc_feature (632)..(632): n is a, c, g, or t
tcagacgagtgcgtcacgaccggtgctcgatttagatcgtctgtgttgggtttgggagtcaggccatcagcgattcttagcctggttgcagcagaaaccagggcgacgccctcagatcgtagtctatggtgacatccgagtattggacgaagggtcggggtcccagtccgaggttcagtggcagtcncatcgtgggacagtacttacactctcgactancacgtcacgacctgacacgtactagaagttntttacgacttaattttacgttactcgtaacaacgtagttatactaccgtaccgtagtcggacgttacggacgagggtaaccgaggtacgaagtacctaacggacgttggtacggcctacgtacccgtaaccttagttccgttagttaccttcgtaacctttccccgttaccccaccccttacacccgttaccgtacctaccgtttagtccggtacggtacgggtcccgggtntaccgggacgtaacgtacggacaagttcgaatcgtaacncgtacgngtacgcgtatacgtcgtcacgtcgacgtacgtacgcgacgtagtacgtcgtacgacgactcgagtacgngtcgctnanctagacacgtactacgtacacgacgngtcg

SEQ ID NO: 215433 - DNA, 766 bp, Homo sapiens
  misc_feature: GYAE6OF01BIV4J.1.34.D01.1.454.CMB.1.raw
  modified_base (104)..(104): a, c, t, g, unknown or other
  misc_feature (104)..(104): n is a, c, g, or t
  modified_base (144)..(144): a, c, t, g, unknown or other
  misc_feature (144)..(144): n is a, c, g, or t
  modified_base (174)..(174): a, c, t, g, unknown or other
  misc_feature (174)..(174): n is a, c, g, or t
  modified_base (534)..(534): a, c, t, g, unknown or other
  misc_feature (534)..(534): n is a, c, g, or t
  modified_base (759)..(759): a, c, t, g, unknown or other
  misc_feature (759)..(759): n is a, c, g, or t
tcagacgagtgcgtcacgaccggtgctcgatttagatcgtctgtgttggggtttgggggagtcagaccctgtcaggacacagcatggacatggacgggtccccntcagcctccgtgggctcctgctgctgtggctccaggtacngcgtgtagacacgtacctaattcgaacccngtcctccacttccctacccgtgttctgtactacttacgtagttaggaccgatacggacttaccactacgttcctacggttcggggaccggacgtacgccgacggtacctacgtcgaagttcgttaactttcgtttaccggtcggttggttaccgacgtacggaaaccggtaaggtaaaccccggggtagggaccccgacccggtaccccttaacggacggttaaccgttacggtttccgtagtttaccgggtacggttcgaaaccgtcgtaccgtaacggtttaaccggttaagggaccgggtttaacggggggtaccccgtttaacgaccgtttaaccggtcgttacggcgggttaacncggttagtcggactacggtacggagtacctagtactacgtactcgtatctactcgcaccgtacgtcgaccgacgtacgtacgtagttacgttattacgtagtacgttattacgtaacttacgtaacttagttaacgtaccgtaccgtccgtacggtacgtaccgggtacgtaccgggtaggtacggaaggtaccgagttaccgtaccacggttcggacgttccgngttaccg

SEQ ID NO: 215434 - DNA, 866 bp, Homo sapiens
  misc_feature: GYAE6OF01DN9B7.1.34.D01.1.454.CMB.1.raw
  modified_base (109)..(109): a, c, t, g, unknown or other
  misc_feature (109)..(109): n is a, c, g, or t
  modified_base (640)..(640): a, c, t, g, unknown or other
  misc_feature (640)..(640): n is a, c, g, or t
  modified_base (661)..(661): a, c, t, g, unknown or other
  misc_feature (661)..(661): n is a, c, g, or t
  modified_base (676)..(676): a, c, t, g, unknown or other
  misc_feature (676)..(676): n is a, c, g, or t
  modified_base (849)..(849): a, c, t, g, unknown or other
  misc_feature (849)..(849): n is a, c, g, or t
  modified_base (858)..(858): a, c, t, g, unknown or other
  misc_feature (858)..(858): n is a, c, g, or t
tcagacgagtgcgtcacgaccggtgctcgatttagatcgtctgtggttggggtttgggggagtcacgaccctgtcaggacacagcagtggacagtggacgggtcccccntcagcctccgtgggcctccgtgctcgctcgtcggcctacccgaggtaccagcttgtacgactactacctaacgttcgaccctagttcctcctactcccgttaccgtgtcctgactacttcgttagtacggaagaccgacggtacctaccaaccttacgtaccgtaaccggttccggggacccgggtacgaccgtaccggaccggtacctacgtaccggaacggttacctttaactttttccggtttaccggtccgtttacgggttacgacccgtaaacggaacccgaaaaccgggaaaccggggaccgggaccccgtaaccccggtaccccgtaacgacggttacgtttaaccggtaacggtttccgtagggttcggtaccgtaccttaaccgtaccggttaaaggtccggtttacggggaacggttaccgggggtaccccgttacccgaacggtttacccggtaggttaccggagggtcggacgttacggctacggtacggtacgaacgggtaactaacgtacgttaccncccgttaacacgtaaccttanaccgcgtcgtaaccnccggtacgactaaccggtacgtttaataacgtttatttacctaagttttaacttaagtccttaaacgtataacgttactttaaccgtacgttaaccgtccggttacgtaccgggttacggaccgggtacggaacgggtactaagggaacctaacggtaacctacggacgtacncgggtaacncgtaaccg

SEQ ID NO: 215435 - DNA, 612 bp, Homo sapiens
  misc_feature: GYAE6OF01DH8WL.1.34.D01.1.454.CMB.1.raw
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
  modified_base (572)..(574): a, c, t, g, unknown or other
  misc_feature (572)..(574): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(586): a, c, t, g, unknown or other
  misc_feature (584)..(586): n is a, c, g, or t
  modified_base (588)..(591): a, c, t, g, unknown or other
  misc_feature (588)..(591): n is a, c, g, or t
  modified_base (594)..(596): a, c, t, g, unknown or other
  misc_feature (594)..(596): n is a, c, g, or t
  modified_base (598)..(599): a, c, t, g, unknown or other
  misc_feature (598)..(599): n is a, c, g, or t
  modified_base (601)..(603): a, c, t, g, unknown or other
  misc_feature (601)..(603): n is a, c, g, or t
  modified_base (606)..(607): a, c, t, g, unknown or other
  misc_feature (606)..(607): n is a, c, g, or t
  modified_base (609)..(612): a, c, t, g, unknown or other
  misc_feature (609)..(612): n is a, c, g, or t
tcagacgagtgcgtcacgaccggtgctcgatttagatcgtctgtgttgggtttgggagtcaggccatcagcgattctttagcctggttgcagcaagaaaccaggggcgacgccccctcagatcgtagtctatgggtgcatccagtattgcaagggttcgggtcccatccgaggttcagtggcagtgcatcgtgggacagtacttacgactctctactatcagcacgcctacggcacgtccgtagaagttatttacgacttaattttaacttacgttacgtaacaaacttagttaaacttttaacgtaaccgttaccccgtaacggtcggtaaccggtttcccggacgggaacggggtaaccgtaggggtaggtaacgtacccgaaacggtaacgttggtacggtcctacgaccctaacctacttcgttcgttaccttacgtacttccccgttccccgactactactaaccggaaccgtcctacgttccgtacgtacgggtagggcccgggttgtaacgggaccggtaacgggcgtacgaacgtagcgactcgatgctanagtccngtccaannntntcgngngnnngnnnngcnnngnncnnngtnnannnn

SEQ ID NO: 215436 - DNA, 716 bp, Homo sapiens
  misc_feature: GYAE6OF01CHMA7.1.34.D01.1.454.CMB.1.raw
  modified_base (102)..(102): a, c, t, g, unknown or other
  misc_feature (102)..(102): n is a, c, g, or t
  modified_base (142)..(142): a, c, t, g, unknown or other
  misc_feature (142)..(142): n is a, c, g, or t
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccngctgtgacatccaattcgacccagtctccatcctccctgtctgctatctattggacacagagtcaccatcacgttcggccgggcgaggtcacggtccagtccgagtccgtaatttctttaggccttggttcgcagacaacggaaaccgagggccgacgccccctnagtacgtcgtagtctagtggtcgactactaccgagtacttcggacgtaacggggtccgggtacccacgttaccggacgggtttacgaggtcgggactaacgggtcgaccgtacgtaccggtaggggaaccctaagggttaaccttaaccgtacctacgttaccaaacctttacgtacgtaacgccgtaaccgtcccgtacggtaccgaccgtacctaagggttaaactttagttttaccgaatttaacgttttaacttacgtacgttaaacgtaagttaacgttaactttaccgtaacccgttaacccgtacggttaccgggtacgttacccgggtacgggtaacggggtaacccgtaagggtaccggtaaacgacggtaaaccgtagtcgggtacgcgtaccggtacc

SEQ ID NO: 215437 - DNA, 906 bp, Homo sapiens
  misc_feature: GYAE6OF01BGA6U.1.34.D01.1.454.CMB.1.raw
tcagacgagtgcgtcacgaccggtgctcgatttagatcgtctgtgttgggtttgggggagtcagaccctgtcaggacacagcatggacagtgacgggtccccgctcagctccgtgggcctcctgctcgctcgtcggcctcccgaggtaccagtcgtgtcgactactaccaagttcgacccacgtcctcctacttccctccctgttctcgactacttcttagttaggaacgaccgaggtactaccacctacgtctacgttcggaccgggtacgtacgtccgacggtacctagtacgagtaccgttatttacgtttacgtccgttgggttacacgtaacgacgaaacggtaaaccggacgggaccccgtaccgtacccccgtagtaacggttaccgttaccggtaacgtttacgttacggttcggtcggaccttaccgtaccgtaaggtcgtttaccgggtaccgggtaacgggggtttacccggtacccctacggttacccggttacggttaaccgtggttacggacgtacggtacgtaaccgcggtttaaccgggacggtacgtaacggtaacttacccgttaccttaccgtaccgtaacgttacgaccgtaacggcccgttaacgtaccgggttacgacccgttacgggtaaccgttaagttaacgttttacgtttaacgttaacgtttaacgttttaaccgtcgttaaacggttacccttaaaggtttaaccggtttacctttaaccgttaccccgttaaaccggttacgggtaccgggttaaccgggttaccccgggtaaccgggggtaaacgggtaccggtaaacgggttaacccggtaaaacccggtaccgttaaacccggttcgggttaccggacccgtttacgggccctaaaccccggg

SEQ ID NO: 215438 - DNA, 788 bp, Homo sapiens
  misc_feature: GYAE6OF01BBBCT.1.34.D01.1.454.CMB.1.raw
  modified_base (102)..(102): a, c, t, g, unknown or other
  misc_feature (102)..(102): n is a, c, g, or t
  modified_base (170)..(170): a, c, t, g, unknown or other
  misc_feature (170)..(170): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattcgacccagtccnccatccctccctgtctgcatctagttggagacagacgtcaccatcacgttcggccggcagtcacggctagtcgaggctattaccgtttagccgttggttgactagacgaacgaaaccggagggccgaccgtcccctagacgtagtcgttaacggttactagtcgggtagacctacgtaccgtaggtaacgttcggaaccggtaacgggggttaccggggtaccccctacttacccgggttaacggtttccgaagggttcggtaccgtagggtttacgaccgttaaacggttccggtacggggtaacctacggttaacgtttaaccgtaacccttaccgttaacctaaccgttactaccggaacgtacgtacggcccgttacggctacggtaccgtaagttaacgttcgttttaacggaactttaacgttttacgttaacttacgttaaacctaacgttagtttaaccgttacggttacccgtacccgggtttaaccggttagggttaacccggttaccggggacggtaaaccccgggggtaacggtaacgggggtttaccggaaaacccgttaccgtaaacccgggtaacggtggttaaccggccgttaccggacccg

SEQ ID NO: 215439 - DNA, 821 bp, Homo sapiens
  misc_feature: GYAE6OF01DS7Z6.1.34.D01.1.454.CMB.1.raw
tcagacgagtgcgtcacgaccggtgctcgatttagatcgtctgtgttggggttgggggagtcagaccctgtcaggacacagcatggacatgacgggtccccgctcagctccgtgggcctcctgctgctcgtggcctcccagggtaccagctgtacgacactacctaattcgaccatctcccacttccctcctgtcctgacactcgtagttagggaacgaacgaagtacgtccaacctacgtaccgtaccgttcgggacccgggaggacgtaccgacgggtaccagtaccgaagtacgttagtttaccttacggtcccgtaggttcgactaacggacaaacggaaaccgacgggaccgaaccgtcccctacgaagtacgtacgtacggtctaggtacggacgactactacgacgtagtaggacggtaacgggtcggtaccctagtacccgtaagtcgaggttacgacgtacggtagaccgtaggtaaccgtagggaacctagtaaccgttaacctactaccttagtaaccttaacgtaccgaacggaccgaccgtaccggttacgacccgtaacgtccgttaacggtaagtttactttaacggtaactttaaaccgttttaacgttaacgtaacgttaaccttaaacggtaatttaacccttaacggttacccgttaaaccccggggttagtaaccccggggttacggttaccccgggaacccggtaaaacgggggtaccggttaaaacggggaaccgggtaaacccgttaacgtaaaaaccccgggtaggttaacggttaaccggtcgtccccggttaaac

SEQ ID NO: 215440 - DNA, 809 bp, Homo sapiens
  misc_feature: GYAE6OF01A0I6L.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctccgaggtaccagctgtgacatccaattcgacccagtctccatccctcctgtctgactattctagttggacgacagtcgtaccacctatcctacgttcggccgggacgacggtaccacgggacctactacgacggaccgttagtttacgttttacggtcccgtttggttaccggaccagaccgtaaacggaaacccggacggggtaccaccggtccccctagacgtacttacggtacgttaccgttaggtcggtacgactacgtaccggagttacgttacggaaccgggttacggggttcccgggtaccctagttacccgtagggtttaccagggtcgacgtacggtcgtacgtacgttcggtaacgggtactaacggttacgttaaccaccgttacaccttaacgtacacggtacgccgtacgaccgttcggacgtaccggtacgtacggttaaacggtttctttaacgtacgttttaaactttacgttaccggttaagtaaaccgtaaactttacggtttaaacctttaaccggtaaccccggtttaccccggttacggggttaccggttacccgggtaccggggtaacccggtacccggggtaaaacggtacggggttaaaccggtaaccgaacccgtaaaccggttacggttaggccgttaccgtacgtacccg

SEQ ID NO: 215441 - DNA, 554 bp, Homo sapiens
  misc_feature: GYAE6OF01BIP22.1.34.D01.1.454.CMB.1.raw
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(554): a, c, t, g, unknown or other
  misc_feature (522)..(554): n is a, c, g, or t
tcagacgagtgcgtcacgaccggtgctcgatttagatcgtctgtgttggggtttgggagtcaggccatcagcgattctttagcctggttgcagcaagaaaccagggcgagcccctcagatcgtagtctatggtgcatccagtatgcgaagggtcgggtccatccaggttcaggtggcagtcgcagtccgtagggacagattaccactctcaactatcagcagccttgacctacggccttaggaagttacgtttttacgacgttaaattttaacttacgttaggtaactaaacctaaggttattaactaaccgtacccgtaggtaccgggttacgtccggaccgaaggggtaccgtaagggtacggacgttacgaaccggtaagtcggtcggactggaccctaacactttcgtagtccttacgacttcccgtacccgccttatccggtaacaccgtccgtaccgtcggttcgaggcgggaccggtcggtacggcgaacggtcgacggtanacgtncctnancnnnnnnnnnnnnnnnnnnnnnnnnnnnnnnnnn

SEQ ID NO: 215442 - DNA, 503 bp, Homo sapiens
  misc_feature: GYAE6OF01EX3VA.1.34.D01.1.454.CMB.1.raw
  modified_base (228)..(228): a, c, t, g, unknown or other
  misc_feature (228)..(228): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (470)..(476): a, c, t, g, unknown or other
  misc_feature (470)..(476): n is a, c, g, or t
  modified_base (478)..(488): a, c, t, g, unknown or other
  misc_feature (478)..(488): n is a, c, g, or t
  modified_base (490)..(503): a, c, t, g, unknown or other
  misc_feature (490)..(503): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtgggtcccatccaggttcagtggcagtgcatcgtgggacagtattacactctcactatcagcagcctgcagcctagatntttgacttaatttatactgtacaactagtattatacgtaccctagtcggacgttcggacgaggggaccgaagggtaggaacgtacgaaccgtaacgtggtggaaaactggaccaaccgtatcgtgtccttacacttccgttcccgacctactacgtacgaaccgtcctacgtccgttcgtgggacgccgggtagtcggaccgaacggccgactaagttacggnagctagntacgngctgcannnnnnngnnnnnnnnnnngnnnnnnnnnnnnnn

SEQ ID NO: 215443 - DNA, 684 bp, Homo sapiens
  misc_feature: GYAE6OF01BXVZA.1.34.D01.1.454.CMB.1.raw
  modified_base (491)..(491): a, c, t, g, unknown or other
  misc_feature (491)..(491): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (639)..(641): a, c, t, g, unknown or other
  misc_feature (639)..(641): n is a, c, g, or t
  modified_base (644)..(644): a, c, t, g, unknown or other
  misc_feature (644)..(644): n is a, c, g, or t
  modified_base (648)..(651): a, c, t, g, unknown or other
  misc_feature (648)..(651): n is a, c, g, or t
  modified_base (653)..(654): a, c, t, g, unknown or other
  misc_feature (653)..(654): n is a, c, g, or t
  modified_base (657)..(658): a, c, t, g, unknown or other
  misc_feature (657)..(658): n is a, c, g, or t
  modified_base (660)..(667): a, c, t, g, unknown or other
  misc_feature (660)..(667): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (673)..(674): a, c, t, g, unknown or other
  misc_feature (673)..(674): n is a, c, g, or t
  modified_base (676)..(676): a, c, t, g, unknown or other
  misc_feature (676)..(676): n is a, c, g, or t
  modified_base (678)..(683): a, c, t, g, unknown or other
  misc_feature (678)..(683): n is a, c, g, or t
tcagacgagtgcgtcacgaccggtgctcgatttagatcgtctgtgtttgggtttgggagtcaggccatcagcgattctttagcctggttgcagcagaaaccaggccgagcccctcagatcgtagtctatggtgcatccagattgcgaagggttcgggggtcccatccgtaggttcaggtggactaggtgcagtcgtagggacagtacttacactctacacttatacgagccacgtcctgccgtaacggtccttaaggtaaagttctttttacggaactttaattttttaacttacgtaggttaacctaaaacgttagtttaactttaaccgttaaccggttaacccccgttacgggttcgggggtaaccgggtttcccgggaaccggtaacggggggaaaccggtaacggggttaggaaacggttacccgaaaaccgggtacgttcgggtacgggcttacggaccctacgtagtttcttcgttacctttanaccccgtttccccttacccccaccccgtttaccgtaccgtccgtacccgttaccgttccggttaaacggtcggaccggggtcccggggtacgttaccggggaaccggaacgggttcccgataaacggtcgatcgagatcacgnacncnnntcnctgnnnntnncgnngnnnnnnnnancncnncncnnnnnnc

SEQ ID NO: 215444 - DNA, 760 bp, Homo sapiens
  misc_feature: GYAE6OF01C27DS.1.34.D01.1.454.CMB.1.raw
  modified_base (551)..(551): a, c, t, g, unknown or other
  misc_feature (551)..(551): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggcctcctgctgctctggcctcccgaggtaccagctgtgacactaccaattcgacccagtcctccactccctccctgtctgcattctagtggagacgtagactccaacctataccgtaccgttcgggcccggggcgtaacggtccgaacgggtaccctaatccgaacggtacgttacttttaccgttttacggcccgtttggggttacaccggaagaccgaaaacggaaaccggcggggaccacccggcccctacgaagtacgttacggtacgtacgtaggtggtacgactaacgtccggtaagtcggttacggacgggtaacgggggttaccgggtcccctaaaggttcccggggtaaggttccggaaggtcgggaccgtagtcgactacggttacggagggactagtaacttacgaccttcgtactaacttnacgactaccgtgcctcgactcgacttaggttaacttagtttcgtaacttaagtttacttactaacgtactaataagtttaacttacgtaacccgttaccggtagggttccggtaccggtaccggggaaccgggtaacggggtaaccgtaacggggttacgtaaaacgtcggtaaacccggttagtccgggtaacgccgtacgtaacccg

SEQ ID NO: 215445 - DNA, 1020 bp, Homo sapiens
  misc_feature: GYAE6OF01BG626.1.34.D01.1.454.CMB.1.raw
  modified_base (182)..(182): a, c, t, g, unknown or other
  misc_feature (182)..(182): n is a, c, g, or t
  modified_base (194)..(194): a, c, t, g, unknown or other
  misc_feature (194)..(194): n is a, c, g, or t
tcagacgagtgcgtcacgaccggtgctcgatttagatcgtctgtgttgggtttgggcatggacatgagggtccccgctcagctcctggggctcctgctgctctgctcccaggtaccagctgtcgacactaccaattcggacccagttctccactccctccgtgtctgctattctagtcgganacagacgtcacnctctacgttcggccgggcgacgtcgacggtaccatcgacgtacgtacttttccttacggtccgttgggttcgaccgtaaggaccgaaaacgggaaacccggacggggtaccggtacccgaccccgttacgtaacgtacggttaccggttacggttacttaacgggttcgggttcgaaccggttacgtaccccgtaaaggtacgtttaccgggaacgggttaaccgggggtttaccgggtaccccgtaacgtacccggggtttaacggggtttaccgaggggttaccgggaccgtaacgggttacgtaccggggttaaacgtttacccgggggttaacgggaaacccggttttaacggtaaaacccgttttaacccccgaccctttaacccggtttaacccctaaccgttacggttaacccggtaaccggtaccccgtacccgggtacccggttaccggtaccggtaaccggtttccgttaaacggttaaacggttttaacgttttaaccggttaaccgttttaaacttttaccgttaacgttaccgttaaacgttaaaccggtttaaccggtttaaacctttaacccgggtttaaccccgtttaaacccgttaaccggggtttacccgggttaaccggggtttacccgggaaccgggttaaaccgggggtaacccggttaaaacggggttacggtaaaaacccgggttccggtaaaaacccgggtaccgggttacgggtttcggtaccgtaacgtacccggtaaacccgttcgtaaccgtttacggtttaccctacctttacccgttccccggttacctaacccgg

SEQ ID NO: 215446 - DNA, 720 bp, Homo sapiens
  misc_feature: GYAE6OF01BQEHA.1.34.D01.1.454.CMB.1.raw
  modified_base (101)..(101): a, c, t, g, unknown or other
  misc_feature (101)..(101): n is a, c, g, or t
  modified_base (318)..(318): a, c, t, g, unknown or other
  misc_feature (318)..(318): n is a, c, g, or t
tcagacgagtgcgtcacgaccggtgctcgatttagatcgtctgtgttgggtttgggggagtcagaccctgtcaggacacagcatggacatgagggtccccnctcagctcctggggctcctgctgctctggcctcccgaggtaccagtctgtgacatccctaattcgaccctagtcctccatccctcctgtctgcattctagtggacgacagacgtccacctatcctacgttcggccgggacgtacgtcgacggaccctagtcgagtcgtattttaccgtttacgccgttggtcgacaggaccaaacggaaaacccggnggggacccgaccgtccccgtacgaggtacgttaccggtacggttacgtaaggtcgggtctaccgtaactaccgtaaggttacgttggaccggtaacgggggttccggtacccctagtacccggtacggttcgaaggtccggtacgtaggtcgacgtacggttccgtaggggtaactacggtaacttcctaacttccgtaactactagtccaagtcgacgtccgtgaccgaccgtcgttagaagttttacttcggtaatttaacgttttactaaccgtagttaacctaaagtttagttaacctaacgttaccccgttaccggttagtacccgggtacggttaccgggcgtaacgggacggtaacgggtcgaacctacgaaccgtagacggtcacgtcgtaccg

SEQ ID NO: 215447 - DNA, 643 bp, Homo sapiens
  misc_feature: GYAE6OF01BHO9T.1.34.D01.1.454.CMB.1.raw
  modified_base (307)..(307): a, c, t, g, unknown or other
  misc_feature (307)..(307): n is a, c, g, or t
  modified_base (431)..(431): a, c, t, g, unknown or other
  misc_feature (431)..(431): n is a, c, g, or t
  modified_base (470)..(470): a, c, t, g, unknown or other
  misc_feature (470)..(470): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagatccaccatcacgttggccgggcagtcaggccatcagctatttcttagcctggttgcagcaagaaccgagggccacgcccctgagtactcgtagtctagtggtcnctactccgagtacttcggacgtaacggggtccgggtacctacgtccgtaggttcctagggtcggacgtaggtcgctaacgtcggtacgggaactagtaactttaccgacttcctactacttacncgacgacgacgtccgtagacacgtacctaggtaaacttnttttacgaactttaacgtttacttactacgtaacctaagttacgttaacttacgtaacccgttaacccggttacgttacgggtaaccggttaccggtacggtaaacggggtaaccgtaagggttacgggtaaactaccggtaaacgtacggttggaccgtacgtcgtaacccg

SEQ ID NO: 215448 - DNA, 661 bp, Homo sapiens
  misc_feature: GYAE6OF01ENDW2.1.34.D01.1.454.CMB.1.raw
  modified_base (103)..(103): a, c, t, g, unknown or other
  misc_feature (103)..(103): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
  modified_base (537)..(537): a, c, t, g, unknown or other
  misc_feature (537)..(537): n is a, c, g, or t
tcagacgagtgcgtcacgaccggtgctcgatttagatcgtctgtgttgggtttgggggagtcagaccctgtcaggacacagcatggacatgacgggtccccgntcagctccgtggggcctcctgctgctcgtggcctccgaggtaccagctgtgacactccaagttcgaccagtcctacctacttcccctcccgtgtctcgactacttcgttagttaggaacgaaccaggtacgtacctaaaccacgttacctaccgttccgggacccggggtacgtaacggttaccgaacggttacccaagttaccgaacggtccgttaacgttttaccgtttacggtcccgtttagggttcgacgtacgaaccgtaaacggaaaccgacgggaccgtaaccggaccccgtacgagtacgtacgtacgttcgtaagtcggtgtacgtactacgagttagtgacgtaacgggtcggacctacgtacgtaggtacaggttccggntagagactgntaganacnanagtagctactanagacgacgtanagacgagagacgtacgagagtacgacgtagagagacgtacgagagtacgtacgtacgacgtacgctagacgtacgtaagacgacgtaacgagaacgtacgtacgtaccgtagtacgtacgaacg

SEQ ID NO: 215449 - DNA, 974 bp, Homo sapiens
  misc_feature: GYAE6OF01EQL9N.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctccgtggggcctcctgctgcctcgtggcctcccgaggtaccagtctgtacgactactacctaacttcgaaccctagttcctaccctacttcccttcccgttgtctcgactattccttagtagggacgtacgagtacgtaccactactactacgttcgggccgggacgacgtcgacggccataccgacggtcttactttaccgtttacggtccgttggttcgaccgaacggacgaaaccgggtaaaaccggccggggtacccgaacccgtcccccggtagtaaggtaaccgttacggttaacgtcttaaggtcgggttacaaccgtacgttaccgaagttacggttacgggtaaccgggtaaacggggggtttcccgggtaacccctaaggtttacccggggttaacggtttccggtaagggttaccgggaacggttaacgggttaaccgtaccgtttaagggtaccgggtaacgggtaacttaacgggttaacccttaaccccttaccgttaacggtttaccaaacgtttcccgaaggtaaacccggtcgttacccgtacccgggttaccgtaaccggttaacggttaccggtttaaacgttaaccgtttttaggttaaaccgttaaactttttttaacggtaccggtttaaacccgttaaccggaaacttttaaacgggtttaacgttaacgtttaaacccccgtttaacccggttaacccgggttaacgggggttacccgttaaccgggggtaaccccgggaaggggtaaaacccgggttaaccggggttaaagggttaaaaccccgtacgggtaaaaacccggttcgggttaacggcggtttacctaagggacccttaacccg

SEQ ID NO: 215450 - DNA, 688 bp, Homo sapiens
  misc_feature: GYAE6OF01CM6RN.1.34.D01.1.454.CMB.1.raw
  modified_base (104)..(104): a, c, t, g, unknown or other
  misc_feature (104)..(104): n is a, c, g, or t
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (675)..(675): a, c, t, g, unknown or other
  misc_feature (675)..(675): n is a, c, g, or t
tcagacgagtgcgtcacgaccggtgctcgatttagatcgtctgtgttggggtttgggggagtcagaccctgtcaggacacagcatggacatggacgggtccccntcagctccgtgggctcctgctgctcgtcggcctacccgaggtaccaggtctggtacgactactacctaattccgaccctatcctcctaccttccctccgtgtactcgactattactagtaggacgacagtacacacctatccgagtcggaccgggngacgtcgacgacatcgaaggtccttacttcgtacgtcgtgtanacgagacgaacgtaacgnggcctacgtcccganagtactcgntacgtaggtccgntaccgntacgagtaccgtaggacgggtacggtcggaccagggttacgacgtggacggtcacggacgtcgacgttaacggcgtaaacggtaaccgtacgtaacgtacctactccgtaactacgtaactaccgacgtacgtacgaccgtaccgtacgaccgtacgtagtttacgttaacgtttaacgttaactttaacgttaacttacggttaactaaacgttaacgttaaagttaccgttacgtaaccggttccgtacggtaccggtacggtaccggacggtaacggaggtacggtacgaagtaccgtacgtagttanacggtcacgtacg

SEQ ID NO: 215451 - DNA, 907 bp, Homo sapiens
  misc_feature: GYAE6OF01D3C5C.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctccgtgggcctctgctgcttcgtcggcctacccgaggtaccagtcgttggtacgacctactacccgtaaacgttccgacccctacgttccctaccctaccctttccccttcccgttcgttacctggtaccttacgttacgttaacgggttacggaaacgtacgtaaccggtacgtaacccctaaccctaccgtacccgtttaccggttacccggggacccggggttaccggtaacggtacccggaaccggttccctaacgtcgtaacggttaccggttttaacgttttaccggttttacccgggtcccggtttgggttaccgaaccggtaaccggaaccggttaaacccgggaaaccgggtccggggaaccccgttaccccgtacccccgttaggaaccgggtttaccgtttacggtttacggtttaactagggttccggtaactacccgtacgttaccgtaaggtttaccggttaccggtaacggggttacccgggggttccctaacccttacggtaccgttaaggttaccgggtcggaaggtccgtaagtccgggtaccttaaggcggaaaccgttaacgtacgttaaccgttaccgtaccttaaccgttcctaacttaccgacgtacgtcgaccggtctacggacgaccgttagtacttaatttggttaacttacgttaatttcgttacgtactattaaccgttattactacgttacccgtccgttaggtccgtaacggtccgaacggtaggaacgtggaaccgacgtacccgtaagtcggttgccgtgcccgtacg

SEQ ID NO: 215452 - DNA, 769 bp, Homo sapiens
  misc_feature: GYAE6OF01CIWQW.1.34.D01.1.454.CMB.1.raw
  modified_base (78)..(78): a, c, t, g, unknown or other
  misc_feature (78)..(78): n is a, c, g, or t
  modified_base (103)..(103): a, c, t, g, unknown or other
  misc_feature (103)..(103): n is a, c, g, or t
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (393)..(393): a, c, t, g, unknown or other
  misc_feature (393)..(393): n is a, c, g, or t
  modified_base (477)..(477): a, c, t, g, unknown or other
  misc_feature (477)..(477): n is a, c, g, or t
  modified_base (627)..(627): a, c, t, g, unknown or other
  misc_feature (627)..(627): n is a, c, g, or t
tcagacgagtgcgtcacgaccggtgctcgatttagatcgtctgtgttgggttgggggagtcagaccctgtcaggacanagcatggacatggacgggtccccgntcagctccgtgggctcctgctgctcgtcggcctcccgaggtaccagctgcgacactaccaattcgacctagtcctccatccctcctgtactnctatctagtggancgagcnccaactctacgtacggtccgggcggtacgtacgtacgaccggtacacgtacggagttaccgttacttttaccgtcgttcggtaggtccgacgacggaaacgtaacccggaacggtccgggaaccccgtcccggtaaccctaggtaaccgtaccgttacgggtacctagttacggggttntacccgtaaccgttacgtaacgtacggtttacggacggtaccggggtaaccggggttcccaccgttacggtcgtaaccggtcgngtaccggcgtacggtactccgtaaaggtccgaagggttaacacgttccctaacctcccgtactaaccgtagtacgtacgaccgacgtccgaccgtcgtaccgtacgtacggtttaagtttcttaacgttacaacgttttcttaaaccgtnttaaacccgttataacggtttaaccttaaggttacccgtacccgttaccgggttgaaccggggttcccaaacggggtacggttaaggacggttacctaacgggcccttaaaccggcgttaggtaccgcgtccgtaacgtacg

SEQ ID NO: 215453 - DNA, 833 bp, Homo sapiens
  misc_feature: GYAE6OF01BF1ID.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtgggcctcctgctgcctctggcctacccgaggtaccagctgtagacatccaattcacccacgtctccactcccttccctgtctgctatcttagttggagacagtacgtccaaccactccgtacgtcggccgggtccgagtcacggctacgtcgaacgtccgttattttaccgttacgtccggttagggtcgaccgaggtaacccgaaacggaaccggtacgggaccgtacccgccccgtaacgaacgttcgttaccggttaacgttcggtacgttagggtccacgtactaccgagtacgttacggaacggtaccgggggtccggtacctacgttacggtacgtaggtacggtgacgtaggtcggacttagtccggtaggacttacgacttaaccgtctcgaactaacgtgaccgagccctacgcgtacgaacccgacgttcgtaaagttaccgttttagttattaaccgttaagttttaaacctcgttaaacgtacccgtttaaagttaacccgggttttaacttaaccccgggttaaacccccgtttaccggggtaccgggttttaaacccggggaacccgggtttacccggggggaaacccggtttaaccggggggtaaaaacccggtccgggttttaaaaacggggtcccccgttaaacggttaaacccgggtcggggttaaaccggtcccgggttaccccgaaccggtttaacccg

SEQ ID NO: 215454 - DNA, 1063 bp, Homo sapiens
  misc_feature: GYAE6OF01BEG5Y.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatcctccctgtctgcatctagttggagacagacgtcaccatcgacttcggccgggcgagtcgacggccagtcagcgtatttcgtttacgccgttggttcgacgtacgaccaaacggaaaccgaggggaccgaccggtaccccctacgaacggtacgttaccggttaacgttacgtaggttcgggtcgtacgtacgttacccgaaggttacgttacggaccggtaacgggggtccgggttaccccgacgtttacccggtacgggtttacgtacgggtcggtaccgtacgggtacgtaccgtacgttaccggtacgggtaaccgtaacggttaacctttaaccgtaccgttacccgttaacctaaacgtttaaccgtaccggtaaaccggcccgttaaaccggtccccgttacgggtaccctaaaccgggttcccgtttaaaggttaaaccggtttttactttttaaccggttaaaaccgtttttaaaacgtttttttaacccgggtttaaccggtttaaacccggtttaaaaccccgttaaaaacgggtttttaaaccgtttttaaaacgttttaacccccgggttttaaaaacccccggggttttaaaccccccggtttaacgggggtttaaaaccccgggggttttaaccccccgggttttaaaaccccgggggggggacccccggggtttaaaaaaccccgggggggggttaaaaccccgggtttaaaaaacccggggggggttttacccgggggttaaaaaaaaccgggtttttaacccccccccccgggtaaaaaaacgggggttttaaaccggggttttaccccgggggggtttttaaaccccgggtaccccgggttttaaacccggttaaaaccccccccgggg

SEQ ID NO: 215455 - DNA, 720 bp, Homo sapiens
  misc_feature: GYAE6OF01EYNL7.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtcctccatccctccctgtctgcatctattggagacagagtcaccatcacttggccggcgagtcaggccatcagcgtattcttagcctggttgcagcaagaaaccgagggaccacgcccctcgagatcgtagtctagtggtgactataccgagtacttggacgtacggggtccgggtaccctaagtcccgtaggtttcgaggtcgggacctaggtcgacgtacgttccggtaggggtaccaaggttaccttaaccgtaccttacctaccaaccgtttaacgtaccgaacggcctaacggtccccgttaggacctaaccggtacccgttaaggtaaagtttaacgtttttacgaacttttaaagtttttaaccgttaacgttacgttaacctaaaacggttacgtttaacttaaaccgttaacccggttaaccccgtttaagggttaccgggtaaccccggttacggggacccggtaagggggtaacccgtaaaggggttacgaaaaccggttacccgaaaccggtaacgttcggttacgggccgtcgtaaccg

SEQ ID NO: 215456 - DNA, 932 bp, Homo sapiens
  misc_feature: GYAE6OF01BISL8.1.34.D01.1.454.CMB.1.raw
  modified_base (102)..(102): a, c, t, g, unknown or other
  misc_feature (102)..(102): n is a, c, g, or t
  modified_base (141)..(141): a, c, t, g, unknown or other
  misc_feature (141)..(141): n is a, c, g, or t
tcagacgagtgcgtcacgaccggtgctcgatttagatcgtctgtgttgggtttgggggagtcagaccctgtcaggacacagcatggacatgagggtccccgntcagctctgggctcctgctgctctggctcccaggtaccngctgtgacataccaagttcgaccccagtctcctatccctccctgtcctgcctacttctacgttggagacagtacgtccgaactacgtcgtaccgttccgggccggggacgtaacgtccgaaacgggtccccgaagttccgaacggtaccgtttaacgtttccggttttaacggtcccgttagggtttcgaccgtaacggaaccgaaacggaaaaccccgggacggggacccgtacccggtccccccgtaacggtaaacgttacgttaccggttaacgttaccgtttaacgtcggggttacaccgtaaccggttacgaaacggttaacgtttacggaacgggttaaaccggggggttcccgggtaaccccgttaaccgtttacccgggtaaggtttacccgaagggttacgggaacccgtaggttaccggaccgtaacgttaccgggtaacgggtacctaaacgttacccgttacaccgtttctaacctacgtaactaccgacgtaccgccgaccttcgaacggtccgtacggtaagttaacgtttcgttttaaccgtaacgttttaaacgttttaaccgtacggttaacgttaacccttaaaggttaaaccgtttaactttaaacccgtacccggttacccggttaccgggggttaaaccggttacccggttaccggggtaaacccggggttaaaccggggggtaacccgttaacgggggtaaaccggttaaaccgtacccgggtaaaaccgggttaccgttaggggccttaacccgggtactaaccccgg

SEQ ID NO: 215457 - DNA, 689 bp, Homo sapiens
  misc_feature: GYAE6OF01EOKRQ.1.34.D01.1.454.CMB.1.raw
  modified_base (102)..(102): a, c, t, g, unknown or other
  misc_feature (102)..(102): n is a, c, g, or t
  modified_base (362)..(362): a, c, t, g, unknown or other
  misc_feature (362)..(362): n is a, c, g, or t
  modified_base (480)..(480): a, c, t, g, unknown or other
  misc_feature (480)..(480): n is a, c, g, or t
  modified_base (682)..(682): a, c, t, g, unknown or other
  misc_feature (682)..(682): n is a, c, g, or t
tcagacgagtgcgtcacgaccggtgctcgatttagatcgtctgtggttgggtttgggggagtcagaccctgtcaggacacagcatggacatgagggtccccntcagctcgtggggctcctgctgctcgtggctcccaggtaccagctgtagactataccctaagttcgaccctagtcctaccacttcccctcctgtctgcattctagtggaacacagactaccactatcctacgttggacccgggtagacgtcgaggcctagtcgacgtcgtactttcgttacgccgttggtacgctacggacaacggaaaccgcgggaccgaccgtcccctagacgtacgtacggtagtacctaggtcgtnacgtctaacgagtagtacgacggtagggtccggtcctaagtcgtaggtacgtacggtggactaggttcacgtagttcggaaggtactaagtactaccgtactaccgtataaccgtaanccgtacgtaccggtacgtaccgtcgaacgtaccgtaccgttaagttaacggttttacttacgtaacttttaaacgtttctaacgggtacttaacgtaaattacttacgttaacgtaccggtaccgttacgggttacggtaccgtacgggaaccgtaagggaacgtaggtaaccgtaacggtaaccacgttacggtagcgtanccggtac

SEQ ID NO: 215458 - DNA, 769 bp, Homo sapiens
  misc_feature: GYAE6OF01D0AXT.1.34.D01.1.454.CMB.1.raw
  modified_base (170)..(170): a, c, t, g, unknown or other
  misc_feature (170)..(170): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtctccatcctcctgtctgcatctattgganacagagtcaccatcacttcggccgggcgagtcaggccagtcagccgtatttccgtttacgccgttggttcgcgtaagaccaaacggaaaaccgaggggaccgaacggccccctagaacgtacttcgtaacgttactacgtggtacnctacttccgaagtacgttacggtaacgaacggggttccggggtcccctaacgttccggtaacggtttacgtaacgggtcggtaccgaagggttcgaaccgtaagttccggtaggggaaacctagggtaaacttaacgtacctaccgttacaaaccgttaactcggaagtacctacgacccgttacggaaccttaacggtacccgttaaggtaaacgtttagtttacgtaacctttaagttttaaaccttacgttacgtaacttaaacttacgtttaacgtttaaccgttaacgttaaccccggtaaggttacccgggtaaccgggttaccgggaacccggtacggggtaaccgtaaggtaacgggtaaaccgtaccgaaaccgtaagttcggacggtaccctacgcgtaacccttaggtcttcgttactaacgtacccttcgtcccttaaccg

SEQ ID NO: 215459 - DNA, 587 bp, Homo sapiens
  misc_feature: GYAE6OF01BDNUW.1.34.D01.1.454.CMB.1.raw
  modified_base (200)..(200): a, c, t, g, unknown or other
  misc_feature (200)..(200): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (556)..(558): a, c, t, g, unknown or other
  misc_feature (556)..(558): n is a, c, g, or t
  modified_base (560)..(563): a, c, t, g, unknown or other
  misc_feature (560)..(563): n is a, c, g, or t
  modified_base (565)..(567): a, c, t, g, unknown or other
  misc_feature (565)..(567): n is a, c, g, or t
  modified_base (571)..(578): a, c, t, g, unknown or other
  misc_feature (571)..(578): n is a, c, g, or t
  modified_base (582)..(585): a, c, t, g, unknown or other
  misc_feature (582)..(585): n is a, c, g, or t
  modified_base (587)..(587): a, c, t, g, unknown or other
  misc_feature (587)..(587): n is a, c, g, or t
tcagacgagtgcgtcacgaccggtgctcgatttagatcgtctgtgttgggtttgggagtcaggccatcagcgattctttagcctggttgcagcagaaaccgagggcgagcccctcagatcgtagtctatggtgcatccagattgcgaaggtcgggtcccatccgaggttcaggtgcagtgcatcgtcggacagtattacncttcgtacacgttatccgagccacgtccctgaccagtccgtaggtaaacgttattttcgacttaagttttacgttaccgttgtacaacgtagttattacgtacgtaaccccgtgtacggtaccgttcggaccgacggggaccgaaggttacggaaacgtaaccgaaccggtaacgtcggtacggacgttacgccggtacctacgtcgttaggtcctttctaccgttccgtcccctaccgacttcgtaacggaccgtcctaccgttcgtacgtacggtagggcccgggaccgttcgggacgtaccgggtaccgtacgtaaccgttagcgtacntacgagngctngngnnanctgngnnngnnnncnnncgcnnnnnnnnctcnnnngn

SEQ ID NO: 215460 - DNA, 757 bp, Homo sapiens
  misc_feature: GYAE6OF01BK9J1.1.34.D01.1.454.CMB.1.raw
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (313)..(313): a, c, t, g, unknown or other
  misc_feature (313)..(313): n is a, c, g, or t
  modified_base (486)..(486): a, c, t, g, unknown or other
  misc_feature (486)..(486): n is a, c, g, or t
tcagacgagtgcgtcacgaccggtgctcgatttagatcgtctgtggttggggtttgggggagtcagaccctgtcaggacacagcatggacatggacgggtcccccgctcagcctccgtggggcctcctgctgctcgtggcctccgaggtaccngctgtanacactactaactcgacccagtcctcctactccctcccgtgtcctgctattcgtagtaggagacganacgaccacatcgtacgtcgggacggcngtacgacgacancagtcgttattcttacggcttggtcaccgagaacgaacggaaaccggnggtacccgcgacccctaggacgtacttacggtacgttagtacgtcggtaactcaaccggtacgtaggttacgtacgggaccgttacgggggtaccgtacctaggaccggttagtcgtaacgggctacgtcgtagactcgttaggacgtactacgtactctactctactcgtanaccgacgtcacgtcgtaccgtagacgtaacgttaggtaactttaggttaaccttaagtttaaacccgttacgtttaaccggtaactttaacttaaactttacgttaaccggtttaacccgtaaaccccgggtttaacggtacccggggtttaccgggtaaccgggttacccgggggtaaccgggttaaacggggtaaccggaacggggttacgttaaaccgggaacccgttaaaccgggacgtcggggttaacctccgggtaactaccccg

SEQ ID NO: 215461 - DNA, 156 bp, Homo sapiens
  misc_feature: GYAE6OF01BYIQA.1.34.D01.1.454.CMB.1.raw
  modified_base (144)..(156): a, c, t, g, unknown or other
  misc_feature (144)..(156): n is a, c, g, or t
tcagacgagtgcgtcacgaccggtgctcgatttagatcgtctgtgttgggttggggagtcagaccctgcaggacacagcatggacatggagggtccccgctcagctccgtggggtctcctgctgctcgtggctcccaggtaccnnnnnnnnnnnnn

SEQ ID NO: 215462 - DNA, 716 bp, Homo sapiens
  misc_feature: GYAE6OF01ELHN8.1.34.D01.1.454.CMB.1.raw
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgaggtccccgctcagctccgtgggcctcctgctgctctggcctacccgaggtaccagctgtacgacatccaagttcgacccacgccctaccacttccctccctgtctcgctatctagttggagacagacgtcaccatctacgttcggccgggacgtagtcgacggtccacgttacgacggtacttaagtttccgttacggtcccgttagggttcgcgaacgaccgaaacggaaacccggaggggacctaaccggccccctagacgtacgttcggtacgttacgttacgtcgggttagcctacgtaccgtagtacgttacggacgtaacggggtccggtaccacgtcccgtaggttcgacgggtacncgtaggttcgacgtacggtcgtaggactaacgtataaccgtactctactacgtataaccgcgacgtaccgtcctagtaccgacctacgtaggttaacttcgtttacaacgtttatttaacgtacgtcgtaaaccgtaagttacgttaacttaccgtaaccggttaccgtacggacgggtttaacccgcgggtacgtaacggggtaacgacgggttaacgaacgttaaccgtaccggttaagcggtaccgtgccgtaccgg

SEQ ID NO: 215463 - DNA, 580 bp, Homo sapiens
  misc_feature: GYAE6OF01B2E70.1.34.D01.1.454.CMB.1.raw
  modified_base (131)..(131): a, c, t, g, unknown or other
  misc_feature (131)..(131): n is a, c, g, or t
  modified_base (196)..(196): a, c, t, g, unknown or other
  misc_feature (196)..(196): n is a, c, g, or t
  modified_base (475)..(475): a, c, t, g, unknown or other
  misc_feature (475)..(475): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (555)..(556): a, c, t, g, unknown or other
  misc_feature (555)..(556): n is a, c, g, or t
  modified_base (558)..(560): a, c, t, g, unknown or other
  misc_feature (558)..(560): n is a, c, g, or t
  modified_base (562)..(563): a, c, t, g, unknown or other
  misc_feature (562)..(563): n is a, c, g, or t
  modified_base (565)..(568): a, c, t, g, unknown or other
  misc_feature (565)..(568): n is a, c, g, or t
  modified_base (570)..(570): a, c, t, g, unknown or other
  misc_feature (570)..(570): n is a, c, g, or t
  modified_base (572)..(574): a, c, t, g, unknown or other
  misc_feature (572)..(574): n is a, c, g, or t
  modified_base (576)..(580): a, c, t, g, unknown or other
  misc_feature (576)..(580): n is a, c, g, or t
tcagacgagtgcgtcacgaccggtgctcgatttagatcgtctgtgtttgggtttgggagtcaggccatcagcgattctttagcctggttgcagcagaaccagggcgagccctcagatcgtagtctagtggngctatccagattgcgtaagggtcgggtcccatccgagttcagtggcagtcgactagtgtcggaanatattaccacttcactacgttacacacgtcacggcctcgcacggtcctagtaagttcttttagacctttaatttacgttacgtagtacctaagtacgttatttaacgtaacccggttacccttaagggtacggtaccggttaccgggacgggaacggggtaccgtaaaggggtacgaaccggtaacgaccggtaacggtcgtacggcctacggacctcacgttctcgtccttcgtactcccgtcccgactataccgtggaacctcgtccgtaccggtcncggggttaacgcgggtccgacgggaccggacggtcgaacgagtacggctaggcagcctgcagcnncncancangcncagnncnnngnntnnnngngnnnannnnn

SEQ ID NO: 215464 - DNA, 805 bp, Homo sapiens
  misc_feature: GYAE6OF01B945B.1.34.D01.1.454.CMB.1.raw
  modified_base (204)..(204): a, c, t, g, unknown or other
  misc_feature (204)..(204): n is a, c, g, or t
tcagacgagtgcgtcacgaccggtgctcgatttagatcgtctgtgttggggtttgggggagtcagaccctgtcaggacacagcatggacatgacgggtccccgctcagctccgtgggctcctgctgctcgtcggctccccgaggtaccagctggtacgacatacctaattcgaccctagtcctaccctagtcccttccctgtcncgtcagttctagtggaagtacagactacaaccattacctacgttgggaccggggtactacgaacggccagtacgagtacgttactttacgttacgtccgttggttacgaccaacggtacaaacggaaaccggacgggacccgaacgccctacgacgtaccgttagtacgttacgacggtcggtagacctacgacgtaaagtacgtacggaacggtacggggtccgtaacctacggttaccgttaggttaccgagggtcgtaacgtagtcgaccgtaggttacggaggtaactaagtcccgttaaacctctacccgttataacttagtacccgaaggtcgtaacgtccgacggtaacggtcctaacggtaacgtttaagtttaccgttttaacgtaatttaactttttaaaggtaccttaccggtaaagttaacctttaaaggtttaaccttaacccgggttaacttaaccccgggtttacgttaacgggggttaccgttacccgggaaaccggggttacggggtaaaccgttaaagggtttaccgaacggttaaaccgaaaccgttcgggtacccggtagtacccgtgtaaaccccgtacg

SEQ ID NO: 215465 - DNA, 850 bp, Homo sapiens
  misc_feature: GYAE6OF01ELZ52.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgagggtccccgntcagctcctggggcctcctgctgctctggctcccaggtaccagctgtgacatccaattcgaccctagtctccactccctcctgtactgctatcgtagttggacgtacgagacgtaccacctactcggtaccttacgggcccggggtacgtaaccggttccgaacgggtccctaataccggtacggttaccgtttaacgttttaccggtttaccggttaccggttcgggttaccgtaccgtaacggtaaccggaaaaccggaaacccgggtaccggggtaacccgtaacccggtaccccgttacggtaacggttaccggtttaccggttaacggttaccgttaggtacgggtactaccgtacgtactaaggttacggtacggtaccggtacggggttccggtacctacgtaccggttacgtacgacgggtacggtacgtacgtacggtacgttaacggtacggtaacgtaacttacgttaaccgtacttaccgtacctacgtaacgttacgaccgtacgtaccgtacccgtacgtacgtaccgtacggtaccgttaagttaaccgtttacttaacgttaacctttaacgtttactaaccgttaacgttaccttaaacgttacgttaacgttacccggttacccgtacccggtaaggttaccggttacccgggtacgggtaccggtaagggtaccggtaacgggtaacgtaacgtaacccggtacgtacgttcggaccgtccgacgtacc

SEQ ID NO: 215466 - DNA, 554 bp, Homo sapiens
  misc_feature: GYAE6OF01EEGDI.1.34.D01.1.454.CMB.1.raw
  modified_base (223)..(223): a, c, t, g, unknown or other
  misc_feature (223)..(223): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (518)..(554): a, c, t, g, unknown or other
  misc_feature (518)..(554): n is a, c, g, or t
tcagacgagtgcgtcacgaccggtgctcgatttagatcgtctgtgttgggtttggagtcaggctattagcaactggttagcctggtatcagcaagaaaccagggaaacgcccctaaactcctaatctctgttgcactccagtttgcagtacggtcggggtcccagtacgtaaggttcagcggacaggtggatcgtgggacagtatttcactctcaccatcgancacgctgcacgctagaattgtttcgactaacttacgttattgaccaacagcctacgtacttaccgttaccctactaccctaccgttacggaccggaaacggtaccaaccggtaggtaaggtaactaaacgttaaaaccggacgttggacggtacgtcgaccaacgttactccttacgttaccttactacccttcccgttacccctctaactacgtaccggaaccgtcctaccggttcgtacgtacgcggggtaccgtcggtacggaacggtacggacctacgaatgatnacgncnnnnnnnnnnnnnnnnnnnnnnnnnnnnnnnnnnnnn

SEQ ID NO: 215467 - DNA, 929 bp, Homo sapiens
  misc_feature: GYAE6OF01BR1HH.1.34.D01.1.454.CMB.1.raw
  modified_base (624)..(624): a, c, t, g, unknown or other
  misc_feature (624)..(624): n is a, c, g, or t
tcagacgagtgcgtcacgaccggtgctcgatttagatcgtctgtgttgggttgggggagtcagaccctgtcaggacacagcatggacatcggacgggtccccgctccagcctccgtggggcctccgtgctgctcgtcggcctacccgacggtaccaggtcgttaggtacgaacctactacccgtaaagttccgaaccccgtacgttccctaccctaccttccccttacccgttggttcctaggaccttaagttccgttaggttacggaacgtaacgtacggtaacgtacccgaaccacgtttaccaccgggtttccggggacccgggggtaaccggtaccggttaccgtacccggggtaacctaccggtaccgtaacgggttacccttaacggttttccggttttaccgtcccggtttacgggtttcgaaccgtacgggaacctaaaccgggaacccgggaccggggtcctaacccggtcccctaaggaacgtaccggttacggttacgttacggttaacgttgggtacctacgtaacgtccggtaagtaccgggttaccgtaaccggggtacggggggtacccgtaacggtaaccggtacccggtagggtccgtttaccgggnggtaccggtacgttaaccgggtctaaaccgggttcggaacggtacggtaaccgtttaacctacctaccttaacgtaccgttaactaccgtacgtacgtcccgtaacgccgtacgtaccgtacgtacgtacggttaaggttatttacggtaactttacggttaaccttcgtaacgttagtaacttaagttaacgtaccggttaaccttaaccgggtacggtaccggtacgggtacccgtaacggggtaaacggacggtaagggtacgtaaccacgggtaacctagggtacgagtccggtatacccg

SEQ ID NO: 215468 - DNA, 844 bp, Homo sapiens
  misc_feature: GYAE6OF01CV6A4.1.34.D01.1.454.CMB.1.raw
  modified_base (101)..(101): a, c, t, g, unknown or other
  misc_feature (101)..(101): n is a, c, g, or t
  modified_base (158)..(158): a, c, t, g, unknown or other
  misc_feature (158)..(158): n is a, c, g, or t
tcagacgagtgcgtcacgaccggtgctcgatttagatcgtctgtgttgggtttgggggagtcagacctgtcaggacacagcatggacatgacgggtccccnctcagcctccgtggggcctcctgctgctctggcctcccgaggtaccagctgtgaacntacctaatcgacccagttcctccactcctcccgtgtctgactattcgtaagttggaacgtacaggacgtccaacctataccgtacgttcggggccgggtacgtacgtaccggacggtacctagtccggaggtaccgttacttttcgtttaccggtcgttcgggttcgacgaagaccgaaacggtaaacccgggagggaccccggacccgtaccccgttacaaggtacgttacggtacgttacgttaggtcggtcactacgtaccgtaagtacggtacgtacgggtaacgggttcggtacccctacgtcccggttaaggtcggtacggtaggacgtacggtcgcgtaacggttcggtaacgggacgtaacgttaacgttaacctaccgttacccttaacgtaaccggttaactcccgaaaggttcccgacggtttaccgaccggtaaccaaccgggtaacgtttacggttaaagttttacccgtttaagttaaccggttaaatttttaccgttaacgtacgttaacttaacgttaaacgtttacttaacgttaaccggttaaccccggttaggtaaccgggttaaccgtacccggggtaaccggaacggggttaacggttaaacggggacgtaaacccggtaacccggtacggttaccgtaggggtaacctcggtaacggtaacccg

SEQ ID NO: 215469 - DNA, 513 bp, Homo sapiens
  misc_feature: GYAE6OF01CQRW4.1.34.D01.1.454.CMB.1.raw
  modified_base (115)..(115): a, c, t, g, unknown or other
  misc_feature (115)..(115): n is a, c, g, or t
  modified_base (240)..(240): a, c, t, g, unknown or other
  misc_feature (240)..(240): n is a, c, g, or t
  modified_base (406)..(406): a, c, t, g, unknown or other
  misc_feature (406)..(406): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (465)..(466): a, c, t, g, unknown or other
  misc_feature (465)..(466): n is a, c, g, or t
  modified_base (469)..(469): a, c, t, g, unknown or other
  misc_feature (469)..(469): n is a, c, g, or t
  modified_base (485)..(499): a, c, t, g, unknown or other
  misc_feature (485)..(499): n is a, c, g, or t
  modified_base (501)..(513): a, c, t, g, unknown or other
  misc_feature (501)..(513): n is a, c, g, or t
tcagacgagtgcgtcacgaccggtgctcgatttagatcgtctgtgtttgggtttgggagtcaggccatcagcgattctttagcctggttgcagcagaaaccagggcgagcccctnagatcgtagtctatggtgcatccagattgcaagggtggggtcccatccgaggttcagtggcagtgcatcgtgggacagacttacactctcatatcgagctagccctgactagacctagaaaggtnttttcgacttaattttactacgtgtaaccaagtagttaattaactacgtacccctagtcggaccgttcggacgtagggaccgaaggtgaagtccaaccgtagtggtcgtctagcaccgattcgtcgttctttcacttacccgttccccacccgttcctacggaccnctaccgttcgtcgtacggaccgtcgggctagggaccgaggcccgatacgtagcngntanntcngccgatgaccagtcgnnnnnnnnnnnnnnngnnnnnnnnnnnnn

SEQ ID NO: 215470 - DNA, 855 bp, Homo sapiens
  misc_feature: GYAE6OF01CCFRY.1.34.D01.1.454.CMB.1.raw
tcagacgagtgcgtcacgaccggtgctcgatttagatcgtctgtgttgggtttgggggagtcagaccctgtcaggacacagcatggacaatggacgggtccccgctcagctccgtggggcctctgctgctcgtcggctcccgaggtaccagctcgtagactactacctaatttccgaaccctagtcctaccacttccctccctgttctagctattctagttcggagacagctaccacctatcctacgttcggaccggcgacgtccgaggccaatccgaggcgttatttccgtttaggccgttaggttacgacgacgaaccgaaacggaaaccggacgggggaccaccggtacccctaccggaaccgtacgtaccggtttaacggttaccgtttaacggtacgggtagtaaccgtaaccgttaccgtaacggttacgtttacgggtaacccggtaacggggggtttacccgggtaccctaaccgggtttccggtaacgggttacggtaacgggttcggtacggtaccggtgtaacgttcggtacgggacggtaaccggtattaacccttaaccgacccttacgtaaccgttattaaccccgtgaaccgtcgtaacgttacccgtagaccggtaacctaccggttaacgttatttaacccggtttatttaactttaacgttttaaaccttacgtacggttaaccttaaacgtttaacgtactttaacccgttaccccggtacccggttaacgggttacccggttaaacgggttcccgggaaacgggttaacccggggagtaaccgggttaagtaacccgtacgtaaaacggtccgttaggcgttcctaacggtaccc

SEQ ID NO: 215471 - DNA, 832 bp, Homo sapiens
  misc_feature: GYAE6OF01B7LOQ.1.34.D01.1.454.CMB.1.raw
tcagacgagtgcgtcacgaccggtgctcgatttagatcgtctgtggttgggttgggcagtggacatgacgggtccccgctcagctccgtgggctcctgctgctctggcctcccgagtaccacgctgtcgacactacctaattcgaccctacgtcctccctacttccctcctgtcctcgtctacttacttacgttaggacgacaggtactcctacctatcctacggttcggccggggtacgtactaccgacggcctaacgtccagggtccttacttttccgtttacggtcccggtttcggttaacgccgacgaaccggaacggaaacccggacggggacctacccgtcccgacgtaacggtaccgttccggtacggttacttaggtaccggtctaccgacgtaccgtacgtcgttaccggtacgggtacggggtaccggtacccgtacgtccgttaggtacgtacggtcggtcggtacgtgccgtaggtcgggtaacggacgtaacttacgttacctccttaccgtacctacttacgtctaacggtccaccggttccacggtacgtaccgttaacgggttcttaaggtttactttacggttaaactttaacttttcttaacgttaaccgttacgttaaatttaaccgtttaacgttaaaccggtttaccccgttccgttaacggggttacccggcggtttaaacccggggccggggtaaaaccggttaccggttaacgggtactaacggttaacggacccgttagggtacggtcgtacgtccgttaacctaccggtataccgttcttcccgttaatcccgtacgttccctaac

SEQ ID NO: 215472 - DNA, 595 bp, Homo sapiens
  misc_feature: GYAE6OF01EZ1XB.1.34.D01.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (562)..(595): a, c, t, g, unknown or other
  misc_feature (562)..(595): n is a, c, g, or t
tcagacgagtgcgtcacgaccggtgctcgatttagatcgtctgtgttgggtttgggagtcaggccatcagcgatttctttagcccttggttgcagcaagaaaaccgaggggcgacgccccctcagatccgtagtctatggtgcatccagtattgacgaaggggtcggggtccccatccgaggttcaggtggcagtgcatcgtagggacagtacttaacnctcacactacncagcacgtcctgccacgcctagaagttattttcgaacttaattttactactgtaacctaactagtttatttaaccgtaccgtaaccccgtaggttaccggggtaccgttccgggacccggaagggggtaaccggtaagggtacgggtaaaccgtaccgaaaccggtacgttgggcggtacctcggaacctacgtattccgttacgttccttacacccgtttccccgtaccccgactacgttaccggtaaccgaaccctcgttacccgttcggttcgacgggtaccgggtcgggtacgtcgggaacccggacgcgacgtatacgacngacnannnnnnnnnnnnnnnnnnnnnnnnnnnnnnnnnn

SEQ ID NO: 215473 - DNA, 824 bp, Homo sapiens
  misc_feature: GYAE6OF01CFPSV.1.34.D01.1.454.CMB.1.raw
  modified_base (400)..(400): a, c, t, g, unknown or other
  misc_feature (400)..(400): n is a, c, g, or t
tcagacgagtgcgtcacgaccggtgctcgatttagatcgtctgtggttgggtttgggggagtcagaccctgtcaggacacagcagtggacagtggacgggtccccgctcagctccgtggggtctccttctgctcgtcggcctccaggtacagctgtgacatccaattcgacctagtcctccactccctcctgtctgctatctagttacggagtacgagtcgtaccaccactacgtacgttacggccggacggtacgtcgacggacctacgtcgaacgtcgtattttaccgttaggtccgttcggtacgccgtacggaaccgaaacggaaccgacggggtacccgtacccggaccccgttaacgtacggtagttcggttacgttacgttaggtgggtaccncgtaacgtaccgtaaggttaccggttacgacggttaaccggggtccgggtaaccctacgttaccgggtacggttacgaacgggtttcggaccggtttagaccggttacctacgggttaaccggaaccgggttactaacggttaacttaccgttaccctactacgttaacctcgtaccggaacggctcgggtaccctcgaaccgttcggaccttaaggttaagtttaccgtttacgtaacttttacgttaacgttcgtaacgttaaccgtaaattttaggttaaccttaacgttccgtaaacccgggttcggtaaaccgggttccgttaaacccggggaccggttaaaccgggtaaacgggtagggacccgttaacggaaaccgttaacggggtacgttgttacccggattcccgaacgttaccg

SEQ ID NO: 215474 - DNA, 769 bp, Homo sapiens
  misc_feature: GYAE6OF01BTGHE.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctcgtggggctctgctgctcgtggcctcccgaggtaccagctggtagacactacctaattcgacctagtctccactccctcctgtctgctacttcttagttacggagacgagacgtaccacctactcctacgttccgggccgggtacggacgtccgacggcctacgtcgagtcgttacttttccgtttacggccgttaggttacgacgtaacgaaccgaaacggaacccggtacggggcccgtacccggaccccgtacgtacggttaacgtacggtagttacgtacggttcggtacgactacgtacgtagtacgtacggacggtaacggggtccggtacctacggtcgtacggttcgacggtcggtacgtaggtctacgtacggttacggacggggtaactaggttaaccttacctacgtaccgttactaaccgtacgacgactaccggtacctcgtacgacgtaccgtacgttaaggttacgtttactttacgtaacttttaactttacttacgtaacgttaacgtaacgttttaacgtacgtttacccgttaaccggttccgttaaccgggttacgtacccgggtacgggtacgggtaacgggacggtaaacggtacgaaccggtaccgtaaacgttcggtaggcggtctacgtacccg

SEQ ID NO: 215475 - DNA, 836 bp, Homo sapiens
  misc_feature: GYAE6OF01BVM5I.1.34.D01.1.454.CMB.1.raw
  modified_base (153)..(153): a, c, t, g, unknown or other
  misc_feature (153)..(153): n is a, c, g, or t
  modified_base (211)..(211): a, c, t, g, unknown or other
  misc_feature (211)..(211): n is a, c, g, or t
  modified_base (824)..(824): a, c, t, g, unknown or other
  misc_feature (824)..(824): n is a, c, g, or t
tcagacgagtgcgtcacgaccggtgctcgatttagatcgtctgtgttggggtttgggggagtcagaccctgtcaggacacagcatggacatggacgggtcccccgctcagctccgtgggcctccgtgctgctcgtcggcctcccgaggtaccngctgtcgactactaccaattccgaccctagtcctaccacttcccttcctgtctgactnttactagtaggacgtacagtactaccaaccagtccgtacgtcggccggacgtagtccgacggacctactcgacgtacgttagttccgtttacggtccgttaggtcgacacggaccgaacggaaaccggtcgggaaccgaccccgtcccgtaagaacgttccgtttaccggttacggtttacgtacggtttacgggacaccctaaacgggttacttaagtaccgggtttccgggaacccgggttaaccggggggtccggtacctaaccggggttaccgggttaggttacgcggggttacacggtacgttaccgacgtttaggaccggttaccgggaacttaacgttaaccgttacctacctaacttaccgttaactaccgtaccgacgacccgttacgtaccctagtccggaaccgtagttaacgttaacgttttgttaaccttaagttttaactttaactttaccgtagttaactaacgttaagtttaccgttaaccgttacccgttaccggttacgggttacccggttaccgggtaaccggttaccggggaacggtttaacgggacggttaacgggaacccgtacggttaacccggttagtaccggtccggnttaccgtaaacg

SEQ ID NO: 215476 - DNA, 760 bp, Homo sapiens
  misc_feature: GYAE6OF01DM28V.1.34.D01.1.454.CMB.1.raw
  modified_base (128)..(128): a, c, t, g, unknown or other
  misc_feature (128)..(128): n is a, c, g, or t
  modified_base (749)..(749): a, c, t, g, unknown or other
  misc_feature (749)..(749): n is a, c, g, or t
tcagacgagtgcgtcacgaccggtgctcgatttagatcgtctgtgttgggtttggggagtcagaccctgtcaggacacagcatggacatgacgggtcccccgctcagctccgtgggctcctgctgctntggctcccgaggtaccagctagtgacatccaattcgaccctagtcctccacttccctccctgtactcgctattctagttcggacgacagtagtccaacctattccgacttgggaccccgggagtacgttccgagggtccctaagaccgaacgttccgtaactttactttacggcccgtttggttcgaccgagaccggaaacgtaaacccggaggaccgtaaccgtcccccgtagaacgtacgtccgttaagtccgtaattcgggactcgtaactccgaagtacttccggacggtaacggggttccggtaccctaatcccggtaaggttccgtaaggtcgtactaggtacgccgttagaccggttagggaactaggttacctaacacttacccctagtataccgtaccggacgtacgtacccgtccggttagacccgttacggtactaacggttaaagtttacggttaccttaatttaaaccgtttttactttaccggtaagacccgtaaagtacgttaactaacgttacgtacccgtaacgtcggaacgttacggaacgtaacccggagtaaaaccgggtcgaaaaccggttcgaaaacccggtacgtagtttacccgggntaacggtaccc

SEQ ID NO: 215477 - DNA, 774 bp, Homo sapiens
  misc_feature: GYAE6OF01EIGX0.1.34.D01.1.454.CMB.1.raw
  modified_base (523)..(523): a, c, t, g, unknown or other
  misc_feature (523)..(523): n is a, c, g, or t
  modified_base (600)..(600): a, c, t, g, unknown or other
  misc_feature (600)..(600): n is a, c, g, or t
  modified_base (618)..(618): a, c, t, g, unknown or other
  misc_feature (618)..(618): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggctcctgctgctcgtcggcctcccaggtaccagctgtacgactactaccaattcgaacccacgttcctccctacttcccctcccgttgtcctcgacctattcgtagttacgggaagaccgagtacgtccaacctactccgtacgttcgggccgggacgtaacggtccgaccgcctaacgtccgaggcgttaatttaccgtttacggtccggttggttcggacgtacgaaccgaaacggaaaaccgcggggacccgaccggtaccccgtacgacgttacgtaccggtacgttaccgtagttgggactactacgtaccgtagtacggtacgtacgggtacggggttaccggtccacggttccgtaggttacgacggtcggtacgtgcgtactacggacgtcggtaanacgttactacctacgttctactaacttcgacgtacgaccgtacgtccgcgacgacgtacgtaactacgttcgtttanactttaattacttaccgngtaacgtacttaacggttagttacccgtaaccgttaccggtacggttaccggtaccgggttaccggaacggggttaacgggtaaccgtaaacgggggtaaccggtaccggtaaacccgtacggttacggtaccgtacgggtccctgtaaaccccgg

SEQ ID NO: 215478 - DNA, 944 bp, Homo sapiens
  misc_feature: GYAE6OF01CPSEB.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttgggtttgggggagtcagaccctgtcaggacacagcatggacatgacgggtccccnctcagctccgtgggcctcctgctgctcgtggcctcccgaggtaccagtctgtacgactataccctaagttccgacccctagttccctcctacttcccctccccttggtcttacggacctagttacttaacggtagggacgaaccgagtaccgttccaacccgtattcccgtaacggttccgggcccggggacttacggtaccgacgggtaccctagtacgacgtccgtttacgttttaccgtttacggtcccggtttagggttacgaccgaacgtaaccgaaaaccggtaaaccggacgggaccccgacccgtaccccgtacgtaacggtaccgtttaccggtacttaccgttagggttacggtacctacgttaccgtaaccggtagtcggttaacgggtaccgggtaaacggggttcccgggttacccctaagtaaccccgggttaggtaccggtaacgggttccggagttaacgccgggtacttacggttaccgggtaggtaaccttagtaacccgtttacccgaccttaccgtacaacgttacgcgtaacccgcgtacccggtcgcgttaccgtacgtaccgttaggttaacttttacgttaccgttaactttttaacggtttaacccttcggttaaaccgttactaaaccggtttacgtttaaccttaaccggtttaacccggtaccccggtttaacgggaccgggttaacccggggtaacccgggaccgggtttaaacccgggggaacgtttaaaccccggggggtaaactaaacccgggttaaaccgttaaccggggtaccgttcggtttccggtaacccgtcccgttaaacccgg

SEQ ID NO: 215479 - DNA, 788 bp, Homo sapiens
  misc_feature: GYAE6OF01C5SME.1.34.D01.1.454.CMB.1.raw
  modified_base (103)..(103): a, c, t, g, unknown or other
  misc_feature (103)..(103): n is a, c, g, or t
  modified_base (211)..(211): a, c, t, g, unknown or other
  misc_feature (211)..(211): n is a, c, g, or t
  modified_base (420)..(420): a, c, t, g, unknown or other
  misc_feature (420)..(420): n is a, c, g, or t
  modified_base (630)..(630): a, c, t, g, unknown or other
  misc_feature (630)..(630): n is a, c, g, or t
  modified_base (769)..(769): a, c, t, g, unknown or other
  misc_feature (769)..(769): n is a, c, g, or t
tcagacgagtgcgtcacgaccggtgctcgatttagatcgtctgtgttggggtttgggagtcagaccctgtcaggacacagcagtggacatggacgggtccccntcagctccgtggggctcctgctgctcgcggcctacccgaggtaccagtctgtacaacactacctaagttccgaccctatccctacctacgttcccctcctgtaccgtnacctacttacgttaggtagggaacacaggtacctacctaacctatccggtacggttccgggaccggggacgtacgtaccgacgccagtccgacgtcgttacgtttacgtttacggaccgttggtacgacaacggaacgaacggaaccggcggggaccgtacccgaccctagtaacgtacgttccgtagttacgtaggtggtacctaacncgtaaccgtagttacggtacggtaacggggtaccgggggtttacccgtaccctaagggttccggtaacggttcggaacgggttcgggacttacggcgtacgtaacggtacgggtacggtaactaacggtacttaccctactccgtaataacctacgaccgtacgcgtcgtaccgacggaaccttaccgttaagtaacgtttaacggtttnttaacgttaaactttacgttaacgtcgtaactacgttaaggttacttaaccgtacggttaaccccgtagtacgggtaccgggttacgtaccggggaccggtaagggtaactaagggaccgttaacgaacgtccgggtanagggttccaacgccggtac

SEQ ID NO: 215480 - DNA, 713 bp, Homo sapiens
  misc_feature: GYAE6OF01E383T.1.34.D01.1.454.CMB.1.raw
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattcgacccagtctccatcctccctgtctgcatctagtggagacagacgtcaccatcacgttcggccggcgagtcaggccatcgagcgtactttcgttacgccgttggttgccgacgacgaaacggaaaccggaggggtaccaccggcccctagaacgtacttccggtagttccgtaggttcgggtacgacctacttaccgaagttacgttacggaccggttaacgggggttccgggtacccctaacgttcccgggtaacggtttccgagggtcggacgtacggtcgaccgtagttcggtaacgggaactaacggtaacttaacccgtacttacctacgtaacttacgtaccgaacgtccgtaaccgtcccgtacgaccgtacggtaccgttaaggtaacgtttactttagaactttaagttttaactacgtacgtaactaagttacgttaacttaccgtacccgttaccgtaggttacggtaccggtcgggacggtaacgggtaacgtaagggtacgtaacgtaaccaaccggtacgtgacggtccgtgtacccg

SEQ ID NO: 215481 - DNA, 837 bp, Homo sapiens
  misc_feature: GYAE6OF01BPIGB.1.34.D01.1.454.CMB.1.raw
tcagacgagtgcgtcacgaccggtgctcgatttagatcgtctgtgttgggtttgggggagtcagaccctgtcaggacacagcatggacatggacgggtccccgctcagctccgtggggctcctgctgctcgtcggcctcccgagggtacccagtccgttggtacgactacttacccaagtttacgacccgtagttcctccctacttcccgtccgtgtctcgactacttcttagttcggaacgacgaggtactccaacctactccgtacgttcggccgggtacgtacgttccgacggacctaacgtacgtaccgtccggtttaactttccgtttaacggcccgtttggttaccgaccgtaacggaccgtaaaacggaaccggtaggggacccctacccggaccccggtagtacgacgtttacggtagtccgttaggtcggtacgactcgtcgaggttaccgtaggtaccgtacgggggtcgtacctaggtacccggttaggttacccgtagggtccgtaaccggtaggttaccgtacgttaccgggttaggtaccggggtaaacttacgggttaaccttacgttaacccgtcttaaccgtaaccgttcgtaacgaacgtccgaaccgttccggtacgtacgtaccgtacggtaaggttaacgttagtttacgtaacttttatacggttactacgttaagacgttaacgttaaccgttacctaaccggttaccgttacgggttaccggaccgggttaccggaccggtaaccggggtactaaccggggtaacgtaaccgtacggtaaacggtcggtacgtcggtaaccgtcgtaaaccgg

SEQ ID NO: 215482 - DNA, 974 bp, Homo sapiens
  misc_feature: GYAE6OF01B3KT5.1.34.D01.1.454.CMB.1.raw
tcagacgagtgcgtcacgaccggtgctcgatttagatcgtctgtgttgggtttgggagtcagaccctgtcaggacacagcagtggacatggacgggtccccgctcagctccgtggggcctcctgctgctcgtcggtcctccaggtaccagtctgtagacactacctaacttccgacccgtacgttccctccctaccttccccttcccgttcgttctcgctacttccttagttaggacggacaggtacgtccaacctactaccgtaccgtttccggggaccggggtaccggtacggtacgaccggacctaacgtaccgacgttacgtttacgtttttaccgttttacggtccggtttcgggtacgtaccgaacgaaccgaaaccggtaaccggggaacggggcccaacccggtaccccgtacgaacggttaaccgtcggtttaacgttcgtttacggttcgggtaccgacgtaaccgttaacggaacggttacgttacggacggggttaaccgggtccgggtaccaccgttcggtaaggttccgagggtcgacgtggtcgacgttcggaccggttagggaacctttaacgtaaccgttacccgtaccgtttacccgttaaccgtacgttaccgttaccgtaccgtaacccgtacggttaccggtaccggtaacggtaacccggtaacggtttaaccgtttaaggttttaacccggtttaagtttaaacttttaaccgtttaaaccgtttaacgttttacccggttaaacgttaacccgtttaacgtttttaaccgttaaccgtttaaaaccccggttcccgggtttaaccgggttaccgggttaacccggggttacccgggtaacccggggaacgggttaaaacccgggttacgggttaaacgggttaaccgttaaaccccggtaaccgggtttaaccgttacgggggtacccgttacggtaaaccccgtcccgg

SEQ ID NO: 215483 - DNA, 749 bp, Homo sapiens
  misc_feature: GYAE6OF01ASG61.1.34.D01.1.454.CMB.1.raw
  modified_base (597)..(597): a, c, t, g, unknown or other
  misc_feature (597)..(597): n is a, c, g, or t
  modified_base (620)..(620): a, c, t, g, unknown or other
  misc_feature (620)..(620): n is a, c, g, or t
  modified_base (688)..(688): a, c, t, g, unknown or other
  misc_feature (688)..(688): n is a, c, g, or t
  modified_base (693)..(693): a, c, t, g, unknown or other
  misc_feature (693)..(693): n is a, c, g, or t
  modified_base (698)..(698): a, c, t, g, unknown or other
  misc_feature (698)..(698): n is a, c, g, or t
  modified_base (704)..(704): a, c, t, g, unknown or other
  misc_feature (704)..(704): n is a, c, g, or t
  modified_base (707)..(707): a, c, t, g, unknown or other
  misc_feature (707)..(707): n is a, c, g, or t
  modified_base (710)..(710): a, c, t, g, unknown or other
  misc_feature (710)..(710): n is a, c, g, or t
  modified_base (713)..(713): a, c, t, g, unknown or other
  misc_feature (713)..(713): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
  modified_base (720)..(721): a, c, t, g, unknown or other
  misc_feature (720)..(721): n is a, c, g, or t
  modified_base (724)..(726): a, c, t, g, unknown or other
  misc_feature (724)..(726): n is a, c, g, or t
  modified_base (728)..(734): a, c, t, g, unknown or other
  misc_feature (728)..(734): n is a, c, g, or t
  modified_base (736)..(749): a, c, t, g, unknown or other
  misc_feature (736)..(749): n is a, c, g, or t
tcagacgagtgcgtcacgaccggtgctcgatttagatcgtctgtgttgggtttgggagtcaggcatcagcgatctttagcctggttgcagcagaaaccaggcgagcccctcgagatcgtagtctagtggtgccaattcccagagtttcgacgtaagggtcgggggtccccatcccgtagggtttccaaggtacgggcctaagggttcgacgtaacgttccggttacgggggaaccctaagggtaaaacgttttccccaaaccggtttaccttcctaaacccgggttcttaccggtaaccgggtcccaacggtcccccgttaggaccccggttaaccggtacccggttaagttaaaacggttaacctttttttcggaccttttaaaaggttttaaacctttttaaccgtacgggtttactaaaaccgtaaccggttttaaaacgttaaccgtttaaaccggtttaacccccggtacggttacggggttaaccggtttaccgggtacccggtaaacgggggaaacccggtttaaaggtaccggggtaaccgttaacgaaacccgtaacggtcgttcggacggtcacgaactacgtcgtntcgtaactcgttcctccgacctnacgttacgacctcgactagcgttcgaacgggccgtagtacggtacccgagttccggaacacgtttaancgtcngttanacgtcnganctncancgngnannagnnnannnnnnnannnnnnnnnnnnnn

SEQ ID NO: 215484 - DNA, 806 bp, Homo sapiens
  misc_feature: GYAE6OF01AIMS7.1.34.D01.1.454.CMB.1.raw
  modified_base (772)..(772): a, c, t, g, unknown or other
  misc_feature (772)..(772): n is a, c, g, or t
tcagacgagtgcgtcacgaccggtgctcgatttagatcgtctgtgttgggtttgggggagtcagaccctgtcaggacacagcatggacatgacgggtcccgctcagctccgtgggctcctgctgctcgtaggcctccacggtacctacgcgtgtagactactacctaattacgacctacgtcctaccacttccctccctgtccgtacgctacgttacctagttacggaacgtacgtaacgtcgtaccaaaccgtctaccgtaacgttcgggcccgggtaactacggtcaacggccctataccggacgttacgtaactttccgtttacggtcggttacggttcggccgtaacggtacgtaaaccggaaccggtacggggaccggtaaccggccccgtttaaggaaccgtacggtttacccgtaggttaccgttaacggtcgggtacctaacttacgtaccggtaacggtagttaccggacgggttaacgggtacccgggtaccgtaagttaacccggtacgggttaaccggacgggtaacgggtcgtaacgggttccgtaacccgttgggttaccgggtaacggtaacggttaacgtaaccgttaaccgttaaccgttacctaccgttaacgttaacgtacgtacgtaccgtaccgtaacgtcgacgtacgtcgtaacgtagttacgtataacgttagttactacggtacgtactaactagttaccgtaacgttccggtaaactcggtacgtacgtacgcggtacggtaacgnggtacgtacgtacggtactcgtaggactgctacg

SEQ ID NO: 215485 - DNA, 700 bp, Homo sapiens
  misc_feature: GYAE6OF01EQQZW.1.34.D01.1.454.CMB.1.raw
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (404)..(404): a, c, t, g, unknown or other
  misc_feature (404)..(404): n is a, c, g, or t
  modified_base (675)..(675): a, c, t, g, unknown or other
  misc_feature (675)..(675): n is a, c, g, or t
tcagacgagtgcgtcacgaccggtgctcgatttagatcgtctgtgttgggtttgggggagtcagaccctgtcaggacacagcatggacatgacgggtccccgctcagctccgtggggcctcctgctgctctggcctcccgaggtaccagctgtcgacactccaattcgacccagtctccactccctccctgtcngcactctagttggganacagcgtacaaccactcgtacgttcggacccgggacgaacgtccgaacgggtccctaagtccgaagggtacttaacttttccgttttaacggcccgttagggttacgacctacggaacaaacggtaaaacccggacggggaccgtaacgtacccccgtacgaagtacgttacggtaacgttcgtagtgggtacnctactaccgaagtacttacggacggtaacggggtccggtacctaagtccgtaaggttcgtaaggtcggtacgacggtacgtactacgtcggtaaggacgtagtaacttacgacctctactacttagacgtacgcgaacgtctacgacacgtactagtaagttcttagacttaagtttaactagtacgtaacaacgttattactaacgtaacccgttacccgtagggttaccgtacggtacggaaccgtaagggacccgtaagggacgtaanaaccgacgtaagtgacgtgacgtac

SEQ ID NO: 215486 - DNA, 782 bp, Homo sapiens
  misc_feature: GYAE6OF01C6CVO.1.34.D01.1.454.CMB.1.raw
  modified_base (104)..(104): a, c, t, g, unknown or other
  misc_feature (104)..(104): n is a, c, g, or t
  modified_base (210)..(210): a, c, t, g, unknown or other
  misc_feature (210)..(210): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtggttgggtttgggggagtcagaccctgtcaggacacagcatggacatgacgggtcccccnctcagctccgtgggctcctgctgctctggcctcccgaggtaccagtctgtgacatccaattcgacccagtcctccacttccctccctgtctgactatctagtgganacgagagtaccaaccatccgacgttcgggacccgggcgagtccgaggacccagtaccgaggaccgttatttccgtttacggccgtttggtgaccgaggacgaaacggaaccggacgggccacgccccctagacgacgttccgtagtccgtaggtggtacnctacgtacgaagtcgtacggaggtaacggggtccggtaaccctacgtttaccggtacggtttacggacggttacgggacgtacggttcgaccgtaagggttccgtaacgggtaacctaaggttaaccttacccgtaaccgttacctaccctaagttaccgtacgaccgtacggacccttaccgtacgtcgaccgtcgttaaagttacgttaagttttacgtaactttaaatttttaccgtacggtcttaaacctaattagtttaacctttaaccgttaccccgtaaccggtttaccgggtacgggtttcccggtaacccggggtaaccgggtaacgggtaacgggttaagggttacccgtaaacgggtacccgtaaacggttaccggtagggtcctacggcccggtaaaccg

SEQ ID NO: 215487 - DNA, 743 bp, Homo sapiens
  misc_feature: GYAE6OF01CIPKZ.1.34.D01.1.454.CMB.1.raw
  modified_base (105)..(105): a, c, t, g, unknown or other
  misc_feature (105)..(105): n is a, c, g, or t
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
  modified_base (539)..(539): a, c, t, g, unknown or other
  misc_feature (539)..(539): n is a, c, g, or t
tcagacgagtgcgtcacgaccggtgctcgatttagatcgtctgtggttggggtttgggggagtcagaccctgtcaggacacagcatggacatggacgggtccccntcagctcgtgggctctgctgctcgtcggctcccgaggtaccagcgtgtgaacctagtaccaagttccgaccctagtcctacctctcccgtcctgtctgctactcgtagtgacgatagactcacntacgtacggtggccggagacgtacgacgccagtaccgagtacctagtttccgttaggtccgttggtacgnaacggccaaacggaaccggcggaccaccggtccccaagtacgttatacggtacgtcgtagtcggtacactaacgtcgtaaaggtccgtaggacgttaaccggggtaccgtacccgtacgtaccggtacgggttcaacgggtggtaccgtaggaacgtcgggtactaccgggttaaggaacgtttagtaaccgttacggtactacctaaccgtagtaccttacggaacgtccgtacgtacnccggtaacgtcgaacgtagtaacgtttataacgttacgtttaattaccgttacgtaacgtaacttacgtaacgttaaccgtaccgttaacccggttaacgttccgggtaccggttaaccgggacgggtacccggtaaagggaaccggtaacggtacggtaaaccgtaaccgtaaaccggtcgtaaggtcgtacgacccgtaacg

SEQ ID NO: 215488 - DNA, 748 bp, Homo sapiens
  misc_feature: GYAE6OF01BV4JV.1.34.D01.1.454.CMB.1.raw
  modified_base (591)..(591): a, c, t, g, unknown or other
  misc_feature (591)..(591): n is a, c, g, or t
  modified_base (731)..(731): a, c, t, g, unknown or other
  misc_feature (731)..(731): n is a, c, g, or t
tcagacgagtgcgtcacgaccggtgctcgatttagatcgtctgtgttgggtttgggggagtcagaccctgtcaggacacagcatgggacatggacgggtcccccgctcagcctccgtggggcctcctgcggctctggctcccaggtaccagctgtgacataccaattcgacccagtcctccactccctccctgtctgacattctagttggaagacagacgtcacctatcctacgttcgggccgggacgtacgtccgaacggcctaagtcggaacgtcgttacttttaccgtttagtccgttgggttacgacgaggaaccaaacggaaaccgacggggacccgaccgtcccctagaggtacgttacggttacgtacgtagtcgggtacacgtacgtaccgagttacgtcgggacggtaacggggtccgggtacccctaggtaccgtaggtacgtacggtcggaccgtaggtcgacgtagtacggtaggaactagtaccttactaccgtcctacgtactacgcgaacgtcgaccgttccgcggtaccacggttactaaggtaatttcgtttaagtactttaattaccgtttanaccgtaactaacgttatttaacgttaccgttacccggttaacccgtacggggttcggtaccccgtacggggacccgggtaaacggggtaacccgtaagggtacccggtaaacggtacccgtaaacggtggtaccgggtancccgttacgacctaccg

SEQ ID NO: 215489 - DNA, 977 bp, Homo sapiens
  misc_feature: GYAE6OF01DQQ4R.1.34.D01.1.454.CMB.1.raw
  modified_base (105)..(105): a, c, t, g, unknown or other
  misc_feature (105)..(105): n is a, c, g, or t
  modified_base (252)..(252): a, c, t, g, unknown or other
  misc_feature (252)..(252): n is a, c, g, or t
tcagacgagtgcgtcacgaccggtgctcgatttagatcgtctgtgttgggtttgggggagtcagaccctgtcaggacacagcatggacatcggacgggtcccccntcagctccgtgggcctcctgctgctcgtcgcctcccgaggtaccagcttggtcaactactacctaattccgacccctagttccctacctccttccctcccgtgtctgcctattcgtagtacgggaacgactaggtactaccaacctntccgtacggttcgggacccggacgtacgtaccggtacgacctaagttccgaggttacccgtttaacttttcccggtttacggtcccggtttagggtccggaaccgaacggtaacccgaaaaccggaaaacccggggtccgggggtaccccgtaacccgtcccccggttaaagtaaccggttaacggtttcccggtttagttaaccggttggtttcgggaccctaacgtttaccaccggttaaggttacgttaccggggaaccgggttaaccgggggttcccggttaaacccctcggggtttaacccggtagggttacccggtaggttaccgggcttaaacggtcggttacgttaccggttaacgggtaaccggtaacttaacgtttaacctttaaccgtacccgtttaactacccgttaaaccgttactaccgtacgaccgtacccgtaccgtacgtaacccgttaccggtacgtttaacgggtttactttacggttttacgttaacttttaacgtttaacgttaccctttacgtaacgttaacctttaacggtttaacccgttaaccggttaaccccgtttacccgggttacggttacccgggttaaccggttacccgggtccgggtaaaacccgggttaacgggttaacgggttaaacccttaccgggtaaacccggtaccggttaacgggtttcccgggaaccgttccggtcccgtaaaccg

SEQ ID NO: 215490 - DNA, 738 bp, Homo sapiens
  misc_feature: GYAE6OF01CXZOW.1.34.D01.1.454.CMB.1.raw
  modified_base (105)..(105): a, c, t, g, unknown or other
  misc_feature (105)..(105): n is a, c, g, or t
  modified_base (137)..(137): a, c, t, g, unknown or other
  misc_feature (137)..(137): n is a, c, g, or t
  modified_base (678)..(678): a, c, t, g, unknown or other
  misc_feature (678)..(678): n is a, c, g, or t
  modified_base (698)..(698): a, c, t, g, unknown or other
  misc_feature (698)..(698): n is a, c, g, or t
  modified_base (702)..(704): a, c, t, g, unknown or other
  misc_feature (702)..(704): n is a, c, g, or t
  modified_base (706)..(738): a, c, t, g, unknown or other
  misc_feature (706)..(738): n is a, c, g, or t
tcagacgagtgcgtcacgaccggtgctcgatttagatcgtctgtggttgggtttgggagtcaggccatcagcgtattctttagcctggttgcagcaagaaaccgngggcgacgcccctcagatcgtagtctatggtncatccagtattcgacgtaagggtcgggtcccagtccgtaggttcaggtcggcagtgctagtcggtagggaacagtactacctactcctacaacttagacgcgaccgacgtcctagccgtacggttaccgtaaggttaaacgttttacgttttaacgtaaaccttttaaagtttttaacttaccgttaacggttaaaccttaaaacgtttaaggttttaaaccttttaaacccggttaacccggttaacccccgggtttaggggttacccggggttacccggggtaccggggtaacccggggtaaaacggggggtaaaccggttaaaggggtaaccgggtaaaaccgtaacccggtaaaccgggttacggtacgggtacggtaccgttaacccgacctaccgttaacgtttcccgtagttttaccctaccgttacccgttcccccgttaaccgaccttaacggtcccgtaaacggtacccgttaaccgttacccgttcgggtaacggttcgggaaccggggccgggttacggacccgggaancccgggagttaccagggtcnctgnnncnnnnnnnnnnnnnnnnnnnnnnnnnnnnnnnnn

SEQ ID NO: 215491 - DNA, 427 bp, Homo sapiens
  misc_feature: GYAE6OF01DL2SQ.1.34.D01.1.454.CMB.1.raw
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (413)..(427): a, c, t, g, unknown or other
  misc_feature (413)..(427): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgccagcctaggaagtacttttgactaaattttattactgtacaacgtagttatttataacgtacccttacgtggtaacgttcggcgaggggaccaaggtggaatcaaccgacgtgtcgctagcaccatcgtgtctctagtccttacccgctaattctggaactcacgtcgtactgacgccgggtnggacaggcnatacgnnnnnnnnnnnnnnn

SEQ ID NO: 215492 - DNA, 638 bp, Homo sapiens
  misc_feature: GYAE6OF01B3NPZ.1.34.D01.1.454.CMB.1.raw
  modified_base (100)..(100): a, c, t, g, unknown or other
  misc_feature (100)..(100): n is a, c, g, or t
  modified_base (202)..(202): a, c, t, g, unknown or other
  misc_feature (202)..(202): n is a, c, g, or t
  modified_base (447)..(447): a, c, t, g, unknown or other
  misc_feature (447)..(447): n is a, c, g, or t
  modified_base (485)..(485): a, c, t, g, unknown or other
  misc_feature (485)..(485): n is a, c, g, or t
  modified_base (520)..(520): a, c, t, g, unknown or other
  misc_feature (520)..(520): n is a, c, g, or t
  modified_base (633)..(633): a, c, t, g, unknown or other
  misc_feature (633)..(633): n is a, c, g, or t
tcagacgagtgcgtcacgaccggtgctcgatttagatcgtctgtgttgggtttgggggagtcagaccctgtcaggacacagcatggacatgagggtcccnctcagctcctgggctcctgctgctctggctcccaggtaccagctgtgacatccaattggaccctagtcctaccactccctccctgtcctgcatctagtgganacagactcacctatccacgttcggcccgggcgaacgtcgaacggcccattcgaacggtcgttatttaccgttttacggcccgttgggttgccagaccaacgaaaacccggaggggacccgaacggcccctacgagtacttacgtacgttctaggtggctacactaccgagtagtaggacgtaaggggtccgggtaccctaactccggtagttcgaggtcggacgtaggtcgctagtcgcgggaanaggttactaccacttccacgtacctataccgaggtacncgcgtcgcggactacgttagtaaagttgtttaacntttaaagttttctaacgtacggtaactaacgtaatttactaactaccggtacccgtagggtacgtaccggtcggaacgggaggtacgagtcggtaacacgtaacgcgatcgtncgtac

SEQ ID NO: 215493 - DNA, 713 bp, Homo sapiens
  misc_feature: GYAE6OF01E5NWH.1.34.D01.1.454.CMB.1.raw
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
  modified_base (641)..(641): a, c, t, g, unknown or other
  misc_feature (641)..(641): n is a, c, g, or t
  modified_base (649)..(649): a, c, t, g, unknown or other
  misc_feature (649)..(649): n is a, c, g, or t
  modified_base (659)..(659): a, c, t, g, unknown or other
  misc_feature (659)..(659): n is a, c, g, or t
  modified_base (684)..(684): a, c, t, g, unknown or other
  misc_feature (684)..(684): n is a, c, g, or t
  modified_base (690)..(690): a, c, t, g, unknown or other
  misc_feature (690)..(690): n is a, c, g, or t
  modified_base (692)..(692): a, c, t, g, unknown or other
  misc_feature (692)..(692): n is a, c, g, or t
  modified_base (696)..(696): a, c, t, g, unknown or other
  misc_feature (696)..(696): n is a, c, g, or t
  modified_base (702)..(703): a, c, t, g, unknown or other
  misc_feature (702)..(703): n is a, c, g, or t
  modified_base (706)..(706): a, c, t, g, unknown or other
  misc_feature (706)..(706): n is a, c, g, or t
tcagacgagtgcgtcacgaccggtgctcgatttagatcgtctgtgttgggtttgggagtcaggccatcagcgattctttagcctggttgcagcagaaaccagggcgacgccctcagattcggtagtctagtggtgctactccgaagtagttggacgtaagggggtccggggtacccctaagttcccgtaagggttacgaggttgggcgtagtcgacgtactggacgggaactaacgttaacttaccgtacttacctcaaccgttacacgacgaccgaccgtcgtaacggcgaccgttacgtaacggtagtttacgtttacgtaacttttaacgtttaacctacgtacggtaaccctaagtttaacgtttaactaccgtaaccccggtttaccccgtaggggtacggttaccccgggtacggaccgggaacggggtaaaccgtaaggtacggaaaccgttaccgtaaaccggtggtacgcgtacgaccgtactacggtactttcggtccttacgtacctttccgcccgttacctacgattaccggtacggccctacggtaccgttacgacggtcggtaccggggtccgacggtggaccggtaaccgtgtacgactagccacgngtagntcgngtgcgacgcncgtcgacncgtgacgtcncagtctcgcgtactcgcgcgtgcgntgtacncncgtnagtagnntcncgtcggc

SEQ ID NO: 215494 - DNA, 734 bp, Homo sapiens
  misc_feature: GYAE6OF01CAM95.1.34.D01.1.454.CMB.1.raw
  modified_base (105)..(105): a, c, t, g, unknown or other
  misc_feature (105)..(105): n is a, c, g, or t
tcagacgagtgcgtcacgaccggtgctcgatttagatcgtctgtgttggggtttgggggagtcagaccctgtcaggacacagcatggacatggacgggtccccgntcagctccgtggggctcctgctgctcgtcggcctcccaggtaccagtctaggtcacactacctaacttcgaaccctagtcctcctactccccttccctgtctcgctattcttaagtcgggaacgaacctagtacgtccaacctagtcgtacggttcgggaccgggacgtacgtccggacggccaagtacgaggtaccttacttttcgttaccgtccgttgggtcgaccacggacaaaccggtaaccggacgggtaccgacccgtcccctagacggtctacggttacgtacgtagtacgtcgtacctacgtaccgtaagtagttacggacgggaaccggttccggaccttagtaccggtagtacgaggtcgaccgagtcgactagtacggtaacggacagttaactacctccttaccgacttaacgtgtaacccagtaccgtacgccgtacgtaaccgtcgtaaccgttaagggtaatttacgttacgttaatttactttactacctagtaacctagttaattactacgttaacccggtcgtaacggttccggacggttacgggaaccgaagggttaaccggtggtaaccggaaactacggtaaccggtagttcggactccgtaccaccg

SEQ ID NO: 215495 - DNA, 773 bp, Homo sapiens
  misc_feature: GYAE6OF01DHJT4.1.34.D01.1.454.CMB.1.raw
  modified_base (103)..(103): a, c, t, g, unknown or other
  misc_feature (103)..(103): n is a, c, g, or t
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
tcagacgagtgcgtcacgaccggtgctcgatttagatcgtctgtgttgggtttgggggagtcagaccctgtcaggacacagcatggacatgacgggtccccgntcagctccgtggggcctcctgctgctctggctccgaggtaccagctgtgacatccaattcgacccagtcctccacttccctcctgtctgctatctagtgganacngtactaccacactacacgttcggaccgggngactcgacggtccagtcgacggtacgttacttttacgtttacggccgttggttacgaccgtaggaaccgaaccgaaaaccggcggggccccgtaaccgtcccctaggaacggttacgttacggttacgtcgttagtgggtacacctacgtacagtagttacggacggttaacgggtccggtaccctagtccgtaggttcgaagggttcggatacgtcgaccttaggttacgggtacggtaactaggtaccttaaccgtccttaacgtacctaaccgttacgtacgaccgtacggcccgttacgtacggacccgtacgtaccggtacgttaagtttttacgttaactaacgtttaacgtttacgttaacgtacgtaacctaagtttaacgtttaacgttaacccgttaccggttaaccccggttacgggtaccgggttaaccggttaccggggaaccgggtaacggggtaacggtaacgggttaaccggacgttaaacccgtaacggtaaccggttggtaccgcggtacctaaccg

SEQ ID NO: 215496 - DNA, 455 bp, Homo sapiens
  misc_feature: GYAE6OF01B0R0C.1.34.D01.1.454.CMB.1.raw
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (427)..(427): a, c, t, g, unknown or other
  misc_feature (427)..(427): n is a, c, g, or t
  modified_base (429)..(455): a, c, t, g, unknown or other
  misc_feature (429)..(455): n is a, c, g, or t
tcagacgagtgcgtcacgaccggtgctcgatttagatcgtctgtgttgggtttgggagtcaggccatcagcgattctttagcctggttgcagcagaaaccaggcccgagcccctcagatcgtagtcctatggtgcatccagattgcaagggtgggtcccatccaggttcagtggcagtgcatcgtgggacagattacactctcactatcagcagcctgcagcctgaagtattttgactaattttatactgtacaaactgttattagtacgtacccctaggtcggaccgttcggccgaggggacctaagggtgaacgtcaaccgatgcggctgccacnttctntcttnactcccttaccccacctcctcgactccacgttccgtctggacggtccgggtctcggggacgaacgggccacgtaatcggncnnnnnnnnnnnnnnnnnnnnnnnnnnn

SEQ ID NO: 215497 - DNA, 807 bp, Homo sapiens
  misc_feature: GYAE6OF01DJJP7.1.34.D01.1.454.CMB.1.raw
  modified_base (229)..(229): a, c, t, g, unknown or other
  misc_feature (229)..(229): n is a, c, g, or t
tcagacgagtgcgtcacgaccggtgctcgatttagatcgtctgtgttgggtttgggcatggacatgagggtccccgctcagctccgtggggctcctgctgctctggctcccaggttaccagctgtcacactcctaattcgaccctagtccttccacttcccgtccctgtctgacctatcttagtgggaacacgaggtctaccaccactaccgacgttcgggcccgggtnaacgtcgacggaccataccgagtccgttatttccgtttacgccgttaggttcgacacgaacgaacggaaccgcgggaccggacctacccctaagaccgtagttcgtaacgttcgttaagtcggtacgactaactacccgttaggtacgttaccggtaacggtaacggggttccggtaccctacgtacgtacggtcgaggtcgtcgtaggtcacgtagtcggtaggaccttacgtaacctactacctcgtaactactacgtcgaccgtcgacccttaggaccgtaactacggtacgttaagtttaaccgtttaaggtttaacctaaacggttttacttacgttaagtaacccggtaaacttaacggttaactttaacgttaaccccgttacccggtttaacgttaccggggttaacccgggttacgggttaaccggaacccggggttaaccggaaaggtaccgggtaaacgttaaacccgggccgttaaacgtaacggtcggtaacgtaccctcggtacgaaaccttcggtttaaccttccgttaacccgttcctttaacccggtcccttaccggtacc

SEQ ID NO: 215498 - DNA, 750 bp, Homo sapiens
  misc_feature: GYAE6OF01D1JPO.1.34.D01.1.454.CMB.1.raw
  modified_base (103)..(103): a, c, t, g, unknown or other
  misc_feature (103)..(103): n is a, c, g, or t
  modified_base (209)..(209): a, c, t, g, unknown or other
  misc_feature (209)..(209): n is a, c, g, or t
  modified_base (379)..(379): a, c, t, g, unknown or other
  misc_feature (379)..(379): n is a, c, g, or t
tcagacgagtgcgtcacgaccggtgctcgatttagatcgtctgtgttgggtttgggggagtcagaccctgtcaggacacagcatggacatggacgggtccccnctcagctccgtggggcctcctgctgctcgtggcctacccgaggtaccagcgtgtagactactacctaattcgacccagtcctaccactccctccctgtctgctatntagtgagacagactaccaccatcgacgtcggccggcgtacgcgacggaccatcagtcgtactttccttacggtcgttggtcgacgtaagaccgaacgaaccggacggggacctacccgccctagacgtacgtacgtagtacgtagtcggtacacctactacgtagtacgnggaccggtaacggggtccgaccctacgttaccggtacggttacgtacggtacggtacgtacgtcgtacgtacggttaccggtagggtaacctaacgggttaacccttaacgtaccccttaccttacgaaacgtttcccggaagaccggtaacccgtgtacccgtacgtaccgtaaaccgtacggttaagttacgtttagtttacttaactttaagttttaacgttacgtaccgttactaagttactttaacttaccggttaacccgttaccgttaggggttcccgtaaccggggtaccgggaacggtaaccgggtaaggtacggaacggtaaccgtacccgtaaggtacgtcggtaacgctccgtaaccgg

SEQ ID NO: 215499 - DNA, 685 bp, Homo sapiens
  misc_feature: GYAE6OF01BC07E.1.34.D01.1.454.CMB.1.raw
  modified_base (101)..(101): a, c, t, g, unknown or other
  misc_feature (101)..(101): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccntcagctccgtgggctcctgctgctctggcctcccaggtaccagctgtgacatccaattcgacccagtctccatcctcctgtctgctatctatggagacagagtcaccatcacgttcggccgggacgagtcgaggccatcgagtcgtattcgtttagccgttggttgcagcgaacgaaaccgngggccgacgcccctgagtacgtcggtagtctagtgggtacgcacgtccgagtagttcggacggtaggggtcgggtacccagtccggtaggttcgacggtacggactagtcgtactacgtacggtacgggaacaggttactttaaccacgttcgtacctactacgtacgacgacctacggtcctaggaccgtaaccgtaccgttaaggtaagtttcgttttacgaacgtttaaacttttacgttacctaggttaacctaacgttagtttaacttaacgttaacccgttaaccccggttaggtccggttaacccgggttacggaccgggtaacggggtaaccgtaagggggtaaccgtaacggttaaccgaaacccggttaggttggcggtccgtcggtacccg

SEQ ID NO: 215500 - DNA, 871 bp, Homo sapiens
  misc_feature: GYAE6OF01AWDS5.1.34.D01.1.454.CMB.1.raw
  modified_base (174)..(174): a, c, t, g, unknown or other
  misc_feature (174)..(174): n is a, c, g, or t
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
tcagacgagtgcgtcacgaccggtgctcgatttagatcgtctgtgttggggtttgggggagtcagaccctgtcaggacacagcatggacatgacgggtccccgctcagctccgtggggctcctgctgctctggcctacccgaggtaccagctgtgacataccaattcgacccgngtacctccactccctcctgtcngactatcttagttgacgacagacgtacaccntccgtacgttcgggcccgggagaccgtcgaacggtacctacgtccgtacggtaccgttacttttaccgttacggttcccgttagggttcgaccgacggaaccgaacggaaacccggacggggtaccgacccgaccccgtacgagttacgtacggttaactcggtacgttcggtactacgtaacgtaccgtaagtacggttaggtacggtaccggggggtcccggttaacaccggttacgtaggttacggtaggtacggacgtagtcgacttaacggtggtaacggacttagtaccgtataccctctaccggtaatcccgtagaacctcgacccgtacccgagtaaccgtaccgttaacgggtaacgtttaacttttacgttaacggtttaaacctttttaggtttaaacctttacccggtaccgttaaaaccgttaacgtttaaacgttttaaccgttacccggtttaaacccggtttaacccggttacggggtttaaaccccggtacccggggttttaaacggggggaacccccggttaaaccgggggggttaaaccctaagggggggttaaccccgtaagggtttaaccccgttaaaccgggtaacggtttccgggaaaccgttcggtaaacccggaacccg

SEQ ID NO: 215501 - DNA, 661 bp, Homo sapiens
  misc_feature: GYAE6OF01CVHX1.1.34.D01.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (490)..(490): a, c, t, g, unknown or other
  misc_feature (490)..(490): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgctatctattgganacagagtcaccatcacttgccggnatcaggccatcagcgtattcttagccttggtgcagctaagaaaccgngggaccgacgccccctanagactcgtagtctatggtacnctataccgagtacttcggacgtaaacggggttcggggtacccctaagttcccgtaacgggttcaggttcgggacctaggttcgacgtagttccggtaggggaaccaggtaactttaacgaccttaccgtactaactacttaccgaagtcctacgcccgtagacacggtacctaggtaacgtnttttacgactttaaatttacttacttagtacctaaactatttaacgttactaaccgttaccccgtaggttaccgggtaccgttacgggaccggtaacggggtaacccgtaaaggggttcgtaaaacggacccgtaaaaccggtacgttggtaacgggtctaccggtaaccg

SEQ ID NO: 215502 - DNA, 777 bp, Homo sapiens
  misc_feature: GYAE6OF01DZYBH.1.34.D01.1.454.CMB.1.raw
  modified_base (154)..(154): a, c, t, g, unknown or other
  misc_feature (154)..(154): n is a, c, g, or t
  modified_base (761)..(761): a, c, t, g, unknown or other
  misc_feature (761)..(761): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctcgtggctcccaggtaccagctgtcgacntccaattcgacccagtcctccacttccctccctgtcctgctattctagttaggacgacgagacgtccaacctattccgtaccgttcggcccggggacgtaacggtccgacggacccagtaccacggaccgtaattttaccgttttacggtcccgttgggtttcgaccgaaggaccgaaacggaaaccggaggggcccgaacggcccccctagacggtacgttacggttacggttaccttaaggttcgggtacgactactacccgaagtacgtttacggacggtaaacggggggttccgggtacccgtacgttaccgtacgggtttcgaacgggttcggtaacgtacggtagtaccgtaacgttcgggttacggggaaactaggttaacctttaccgaccctttacctacctaaccttacgttccaacggtacctaacggtccctacggaccgtacgaccgtttaaggtaacgtttagttttacgtaattaacgtttttaactacgttacgttaactaacgttaagtttacttacgttaaccgtacccgttacggtcggtaccgtccggacggtaacgggactagggtacgacgtaacgaacgtacgnggtaccgtgtcgtacc

SEQ ID NO: 215503 - DNA, 809 bp, Homo sapiens
  misc_feature: GYAE6OF01AFYUQ.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagtgganacagacgtccaccgatcgtacgttcggccggggacgacggtaccgacgggcctatccgaggacgttactttccgtttaacggtcccgttgggttcgaccgacgaccgaaacggaaacccggacggggacctacccggtaccccctacgaacggtacgttacggtagttacctaggtggtacgactacgtaccgagtatcggacggtacggggtccggtaccacgttccggtacggttcgaacgggtcggacgtacggtcgtactagtcggtaagggtactacggtaattaccgacgttaccgtactaccttagtaccgacggtcgtaaccgtcgtacgaaccgaccgtaccgttaaggtaaccgtttagtttaccgtaacgttttaacgttttaacctttaccggtaagtttaacccgtaaacgtttaacggtttaacctttaacccggttaacccggttaccccgtttaacggggtttacccgggtaacccgggttaaccccggggtaccggggttaaaccggggtaaccggttaacgggggttaaaccgtaacggttaaccccggtaaccggtaacggtttacggaccggttaccgtaccggtaaccccg

SEQ ID NO: 215504 - DNA, 745 bp, Homo sapiens
  misc_feature: GYAE6OF01B3XFK.1.34.D01.1.454.CMB.1.raw
  modified_base (195)..(195): a, c, t, g, unknown or other
  misc_feature (195)..(195): n is a, c, g, or t
tcagacgagtgcgtcacgaccggtgctcgatttagatcgtctgtgttgggtttgggggagtcagaccctgtcaggacacagcatggacatggagggtcccccgctcagcctccgtggggctcctgctgctctggcctcccgaggtaccagctgtgacactccaattcgacccagtcctccactccctccctgtcngcatctagtggagacagagtcaccatctacgtcggccgggacgagtcgacggccatcgagactactttccgttacgtccgttggttcgcgacgacgaaacggaaacccggacggggaccggacccgtaccccgacgtaaggtaaccgttaccggttaacgttaccttaggtcgggtacgacaacgttaccggaacgtacgttacgggaacggggttaaacgggggttcccgggtaaccccgacgttacccgggttaacggtttcgaagggtccgggtaacgtacgggcgtacctacggtacggtacgggtaactacggttaaccttaccggtaaccttccttactaacgttacgaccgtacgaacgtaccgtaccgtacgtccgagtacgtaagttaacgtttactttaagtaacgtttaattacgttaactcgttaacctaagttagttaacttacgttaacccgttaccgtacggttcggtacggtaccggacggtacgggtaacggtaggtacggtaacgtaccgtacgtacgacggtgcgtcgtac

SEQ ID NO: 215505 - DNA, 900 bp, Homo sapiens
  misc_feature: GYAE6OF01DI287.1.34.D01.1.454.CMB.1.raw
  modified_base (101)..(101): a, c, t, g, unknown or other
  misc_feature (101)..(101): n is a, c, g, or t
  modified_base (144)..(144): a, c, t, g, unknown or other
  misc_feature (144)..(144): n is a, c, g, or t
  modified_base (660)..(660): a, c, t, g, unknown or other
  misc_feature (660)..(660): n is a, c, g, or t
tcagacgagtgcgtcacgaccggtgctcgatttagatcgtctgtgttgggttgggggatcagaccctgtcaggacacagcatggacatggacggtccccgntcagctcgtgggctcctgctgctgtcggctacccgaggtaccngtctagtgactataccgaattcgaccctgtcctccactccctcctagtctgcctatactagtggaacacgtaggtactaccaaccgtatccgtacgtccgggccggacgtaggtccgaggaccctagtaccgaagttccggttacttttacgttaccggccggttggttacgacgtaacggaacaaaccggaaaaccggcgggaccgacccgtaccccgtaagacggttacgttaccggttaacggtaacgttggttacggtaccggtaactacccgtaaccgtaaggttacggtttaccgggaacgggtaaccgggggtttcccgggtaacccttaccggggttaaaccgggttacggttcggtaaacggtcgggtaacgtaagggtcctaccgtacgggttaccggtaagggtaacttaacgtaacttacccgtaccttacctaacgtacttacgtacgaaccgtacgtacggaccgtagccgtaacggtaaccgttaaggttaacccggtttntttaaccgttaacgttttaacgtttaccggttaagtaaccggttaacttaacgtttaactttaacccgttaagtttacccccgggttaaaccggtttccggggtacccggttaaccggggtttacccgggaaaccggggttaaccggggaaaaccggttaaacggggttaacccggtaaaccggttaacccggtaaccgggtttaactacgggggtaactacccgggtacgtaaccccgg

SEQ ID NO: 215506 - DNA, 767 bp, Homo sapiens
  misc_feature: GYAE6OF01AW76B.1.34.D01.1.454.CMB.1.raw
  modified_base (123)..(123): a, c, t, g, unknown or other
  misc_feature (123)..(123): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (726)..(726): a, c, t, g, unknown or other
  misc_feature (726)..(726): n is a, c, g, or t
tcagacgagtgcgtcacgaccggtgctcgatttagatcgtctgtgttgggttgggcatggacatgacgggtccccgctcagctccgtggggctcctgctgctcgtggcctacccgaggtaccngtctgtacgactactacctaagttcgacctacgtcctacctacttcccgttcctgtctcgtactacttcgtagtaggaacgtacgacgacgtaccactactcgtacggtcggccggngtacgtcgacgtctacncgtatacgttacttcgtacgtcgttaggtcgactacggaccgaacgaaccggtgggacctacccgtcccgtaggtacgttacgttacggttcgttaggttagtaccggtacgtaccgtaccgttaggtaacgtacggttaccgggaacgggtttaccggggtcccggtaccacgttcggtagtcgagtcgagtacgtgagtacgtcggactagtactacgttccacttaccgagtaccgtagcgtacgtcgtaccgtacacgacgtactaacgggttattaacgtacgttacttaacgtttatttacgtagtaaccggtaataacgtttacggtttaccgttaccgtaaccgttccgggttaaccggtacggtaaccggggttaccgaacgggggttaacgtaacggtaacgggacgtaaacccgttaccgggaaggtcgtcggtacgtaccaggttcccgaccgtttnccggttttacgacccttacggttacccgttcctaaccgtcg

SEQ ID NO: 215507 - DNA, 799 bp, Homo sapiens
  misc_feature: GYAE6OF01BCIX4.1.34.D01.1.454.CMB.1.raw
  modified_base (102)..(102): a, c, t, g, unknown or other
  misc_feature (102)..(102): n is a, c, g, or t
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
tcagacgagtgcgtcacgaccggtgctcgatttagatcgtctgtgttgggtttgggggagtcagaccctgtcaggacacagcatggacatgagggtccccgntcagctccgtgggctcctgctgctctggctcccaggtaccagctgtagacatcccaaattcgaccctagtcctccatcctcctgtctgcattcgtatgganacgagactcaccagtcncgttcggccgggactagacgacggtaccatccgagtcgtatttcttagtccgtaggttcgacgacgtaacgaaacggtaaaccggagggtaccaccgtacccctagtaacggaacgtacggttaacggttcctaaggttcggtagacctacttaaccgaagttaccgttaggaaccggtaaacggggtcgggtaacccctaaggtacccgttaaggtacgaagggttcgtaacgtagtacgtaccgtaagttacccggaagggtaactaaggtaaccttaccgtaacctacgtaccttaaacgtactaacgacgtaccgaacgtacccgtgaaccgacgtaaccgtaaagggttacgtttaacgtttacgtaaagtttacttttaaacgtttacgtaacggttaactaaaacgttaggtttaaacttaacgttaacccgttaaccccggttagggttaccggttaaccggggttaccggaacggggtaaacgggaaacccggttaaaggggtaaccggtaaacgttaaccccgtaaaaacggtaccggttaaggtaccgggtacttaccgggtaaaccc

SEQ ID NO: 215508 - DNA, 836 bp, Homo sapiens
  misc_feature: GYAE6OF01CA3T7.1.34.D01.1.454.CMB.1.raw
  modified_base (104)..(104): a, c, t, g, unknown or other
  misc_feature (104)..(104): n is a, c, g, or t
  modified_base (128)..(128): a, c, t, g, unknown or other
  misc_feature (128)..(128): n is a, c, g, or t
  modified_base (217)..(217): a, c, t, g, unknown or other
  misc_feature (217)..(217): n is a, c, g, or t
  modified_base (559)..(559): a, c, t, g, unknown or other
  misc_feature (559)..(559): n is a, c, g, or t
tcagacgagtgcgtcacgaccggtgctcgatttagatcgtctgtgttggggtttgggggagtcagaccctgtcaggacacagcatggacatgacgggtccccgntcagctcgtgggctctgctgtctntcggcctacccgaggtaccaggtctaggtcgactactaccgaattcgaccctatcctccatccctccctgtctgactattctagtgganacagtacgttccaactagtcctacggtccggccgggagtacgtacgacggacctatacgagtccgttaactttccttaacgggcctttggggtacacggtaccgtacgaaacggtaacccgggcgggttacccggaccctccccgttaggacggtaaccgtttacggttaactcggttaagtttccggaacgtacctacgttaccgtaagttcggtttaacggaccggtaacggggttcccggaccttacggtacggttacggtaccgtagggtaccgtgtacggttcacgtaagtccgggttaaggaacttatacctacgtctaccgttactaacgttacncggacttacggaccgttcgcgttacgacggtacttagtaactttacgttacttaacggtttaatttaacggttacctaacgtaactaggtttaaacctttcttaaacccggtttaccccgtaacggggtttaccggtaacccgggtttaacgggggttaccccgaaacgggggttaacccgggaaacgggtttaccggtaaacggggttaaacccctaacccgggttaaaacccggggtggtttaaacccggtccggtacggttccgggtaaacccc

SEQ ID NO: 215509 - DNA, 732 bp, Homo sapiens
  misc_feature: GYAE6OF01A3TXV.1.34.D01.1.454.CMB.1.raw
  modified_base (244)..(244): a, c, t, g, unknown or other
  misc_feature (244)..(244): n is a, c, g, or t
  modified_base (648)..(648): a, c, t, g, unknown or other
  misc_feature (648)..(648): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaaggtcgggtcccatccaggttcagtcggcagtgctatcgtgggacagtacttacactctacactactacacgtcacgtcctgcgacgccgtagtaagttnttttacgaacttaaacttttacttacgtcgtaactaaaccgtagtttaacttaacgtaccttaaccccggtacggttcggaccggttccgaccggtacggggaacctaaggggtacggtaacgtaccgtaacccgtagtacggtacggtacgtcggacctaccgtactcgttaccgttcttaacctccgtttacccctttcccccgtacccgttcccgtaacggtaccgtaccgttacccgtccggtttacccgtaggggtaaccgggcccgggttaccggtaccggggtaacggtaacccggggtccggtaaacgttacgtccgggtaatctacggtacctggaactcggtaacctatacgggtctaccgttcggaacctttgccggtaaggttcaaccgttntacgtacgtaccgtacgtagtacgtacgtaccgtagtacgacgtagcgcgtacgtacgtactacgtacacgtacgtgtcgtacg

SEQ ID NO: 215510 - DNA, 768 bp, Homo sapiens
  misc_feature: GYAE6OF01BSUQY.1.34.D01.1.454.CMB.1.raw
tcagacgagtgcgtcacgaccggtgctcgatttagatcgtctgtgttgggtttgggggagtcagaccctgtcaggacacagcatggacatgacgggtccccgctcagctcctggggctcctgctgctctggctcccaggtaccagctgtgacatccaattcgacccagtcctccactccctccctgtctgctatctagttggagacagagtcaccatcacgttcggccgggcgacgtcaggccatcagcgtatttcgtttacggccgttggttcgacacgacgaaacggaaaacccggaggggtccgaaccgtcccccgtacgaacgggtacgttacgggttacgttaccgttaaggttcgggtacgtacctaacgttaccgaaggtacgtttcggaaccggtaacgggggtccggggtacccctacgtaccggtacggttacgagggttcgggacgtaggtcgactagtcggtaggaactagtacgttaccactccgtacactatcgacgcctacgtccgtgacctacggtccgtagtaacgtttactttagtaactttaacgtttttacgttaaccgtacgttaacgaactttaaggttaacctttaccggttaaccgttaccccggtagggtttacccgggttacccgggttacccgggaaacccggggtaaccggggtaacccggtaaggggttaacccggtaaacggttaaaccccggtaaacggtaaccgttccgggtaaccggtccgtacggtaaaccccg

SEQ ID NO: 215511 - DNA, 821 bp, Homo sapiens
  misc_feature: GYAE6OF01BNIJ1.1.34.D01.1.454.CMB.1.raw
  modified_base (208)..(208): a, c, t, g, unknown or other
  misc_feature (208)..(208): n is a, c, g, or t
tcagacgagtgcgtcacgaccggtgctcgatttagatcgtctgtggttgggttgggggagtcagaccctgtcaggacacagcatggacatgacgggtccccgctcagctccgtgggcctctgctgctctggctcccgaggtaccagctgtgacatccaattcgacccagtcctccactccgtccctgtctgacctatccttagtgganaccgaggtacgtccaacctatcgtacgttcgggaccgggcgtagtcgaacggtccctaagtcgacggtcttaacgtttcttagccgttggtcgacgtagaccgtaaacggaaccggacgggtccgacccggtcccctaggtacggtacgttcgtaaggtcgtaacgtcgggactcgaattccgtaagtacgttacggaaccggtacgggggtcccggtacctaccgttaccggtacggttacgtacgggttcggacctaggggtaccacggttcggtacgtacgggtaactacggtactacctcccgtataccggtaacttacaccggtacgcctaccgtcccgtagggtccaaccgggtttcgtaacggttaagtttaactttcgggtaactttaaactttacggttaaccgtacgtaaccttaaaggggttaactttaacggtttcccggtaaaccccgtttacccggtaagggttacccgggtaccccgggtttacggaacccgggggtttaaacgggacgggttcccgggtaaaaggggttacccccgttaaaccccggtacgggttaaaccccgtgggggttaccccgtccgtttaaaccggaccccg

SEQ ID NO: 215512 - DNA, 908 bp, Homo sapiens
  misc_feature: GYAE6OF01CAMMY.1.34.D01.1.454.CMB.1.raw
  modified_base (680)..(680): a, c, t, g, unknown or other
  misc_feature (680)..(680): n is a, c, g, or t
tcagacgagtgcgtcacgaccggtgctcgatttagatcgtctgtggttgggtttgggggagtcagaccctgtcaggacacagcagtggacagtggacgggtcccccgctcagcctccgtggggcctcctgctgtcctcgtcggcctcccgaacggtaccgagtcgtggtacacctactacctaacgttccgaccctacgtcctaccctaccttccccttcccgttcgttcctcgtacctacttacgttaggttaggaacgaacgacggactacccactactaccgtaccggttcggaccgggacgacgtcgaccggacagtaccgacgtacgtttactttcgttacgtccgtggtacgacgtacgacgaaacggaccggacggtaccgacccgacctagacgtacgtacgttacgtacgttggacggtactacgtactacggtagtacggtacgggaaccggttacggggggtacccgtacccgtacgttacccggggtagttaccgggagggtaccgggacttaacgggtcctaacggtaccggtttaacggggaacgtaacgtacgttaacccttaacctacctaccgttaacccttaacgaacggtacccgtagaccccggtaccttaccgggaacgtaccgggttaaccctaaggtttaacgggttaaaccttttnttttaaaccggtttaacttttaaaggtttacccttacggttaactaaacccgttaaatttttaacccggtaactttaaccccggaacccggtttaacgggtaccgggttaaccgggtaacccggggttacggtaaaccgggggtaaccggtaaggttaaccggggaacggtaaacccgtaacgggtaaccgtaagggttccccgggtaatccccgtaacgtaaccccg

SEQ ID NO: 215513 - DNA, 852 bp, Homo sapiens
  misc_feature: GYAE6OF01BDPQT.1.34.D01.1.454.CMB.1.raw
  modified_base (197)..(197): a, c, t, g, unknown or other
  misc_feature (197)..(197): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttggggagtcagaccctgtcaggacacagcagtggacatggacgggtccccgctcgagcctccgtcggggctcctgctcggctcgtggcctacccgacgtaccagcttggtacgactatccctaattccgaccctacgtcctaccncctcccgttccgtgtctcgctacgttactagtcggagtacgagtactacaacctagtctacgttcggccgggtagtacgtccgacggtaccagtacgaggaccttacgtttaccgtttacgccggttgggtaccacgaagtacgaaacggaaccgcgggtccaccgtcccgtagacgtcgtacgacgtgtgtgggtacnctaacgtccgtaagtacgttacggaggtacggggtcccggtacctcgtacggtacggttacgacggtcgtcgtacgttagccgttagtacgggtaggaaaccgttagtaccgttaaccgtaccttacgaacccgttaacgttcgtaaaccggcgtaacccggtaccctacggtacggtaacccgtaaccggttacgttaacggttaacggtttactttaacctaaacggtttttaaaccgtttacgttaacgttaaccccggtaagtttaacttaaaccgttttacttaacccgggttacccccgtttaaccggtacgggttaacccggttacccgggtaaccggggtaaacccggggttacccgggtaaacgggtaaaacggttaccgggtaaaccgtttaaaacccgacccggtttaggggtacccgtaccggtaaaccgggttcccgtacccg

SEQ ID NO: 215514 - DNA, 553 bp, Homo sapiens
  misc_feature: GYAE6OF01BEH60.1.34.D01.1.454.CMB.1.raw
  modified_base (245)..(245): a, c, t, g, unknown or other
  misc_feature (245)..(245): n is a, c, g, or t
  modified_base (431)..(431): a, c, t, g, unknown or other
  misc_feature (431)..(431): n is a, c, g, or t
  modified_base (514)..(514): a, c, t, g, unknown or other
  misc_feature (514)..(514): n is a, c, g, or t
  modified_base (522)..(524): a, c, t, g, unknown or other
  misc_feature (522)..(524): n is a, c, g, or t
  modified_base (526)..(553): a, c, t, g, unknown or other
  misc_feature (526)..(553): n is a, c, g, or t
tcagacgagtgcgtcacgaccggtgctcgatttagatcgtctgtgttgggtttgggagtcaggccatcagcgattctttagcctggttgcagcagaaaccagggcgacgcccctcagatcgtagtctatggtgcatccagtattgacgaagggtcggggtcccatccgaggttcagtgcagtgcatcgtagggacagtacttaccactcctacactatcagcacgcctgcacgtctagtaagttnttttagacttaattttacttacgtagtactaactagttaatttactaacccgtacccgttacggtccggtaccggttccgggaccggaacggggtaaccgtaagggtacggtaacgtacccgaacgtaaggtggtcggctacgccgtactactcggttaactccttacacctcccgtccctacctntccgtaacggtaaccgcctaccgttccgtaccgtagggccgtccggggtactacgggaccgaaccgggtccgaacgtagacgntcgcatgnnngnnnnnnnnnnnnnnnnnnnnnnnnnnnn

SEQ ID NO: 215515 - DNA, 802 bp, Homo sapiens
  misc_feature: GYAE6OF01C6WCD.1.34.D01.1.454.CMB.1.raw
  modified_base (622)..(622): a, c, t, g, unknown or other
  misc_feature (622)..(622): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggcctcccgaggtaccagctgtcgacatccaattcgacccagtcctaccactccttccctgtctcgctatctagttcggacgacaggacgtaccacctataccgtaccgttggacccgggacgtacgtaccgaacgggacccaagttccgaagtaccggttatttaccgttttaacggcccgtttacgggttacgacggaaccggaccgaaaccgggtaaaaaccggacgggggtcccgtaaccggtaccccccgtactaaacgggtaccgtttaccggttaacgttaccgtttaggttcgggtacggtaacctaacgttaacccgtaagggtaacgtttacgggaccggttaaacgggggttcccgggttaccccctaaggttccccggtaaaggttttcgaacgggtcggaccgtaagggtcgtaccgtagtcggtacgggactacggtaatttacccacgttcctaacaacgttactacgaacggtaccnccggtactaggactacgtacgtagttaaacgttgtttacacgttaaattttacaggtactacctaagttacgtttaattacgtaccggtaacccgttgtaccgggtacggttaccggacggtaagggtaaccgtacggaggttaaaccgcgtaaccggtagtagggtcacgttgaacccg

SEQ ID NO: 215516 - DNA, 765 bp, Homo sapiens
  misc_feature: GYAE6OF01EWYWL.1.34.D01.1.454.CMB.1.raw
  modified_base (189)..(189): a, c, t, g, unknown or other
  misc_feature (189)..(189): n is a, c, g, or t
  modified_base (208)..(208): a, c, t, g, unknown or other
  misc_feature (208)..(208): n is a, c, g, or t
tcagacgagtgcgtcacgaccggtgctcgatttagatcgtctgtgttgggttgggggagtcagaccctgtcaggacacagcatggacatgacgggtccccgctcagctccgtggggctacctgctcgctcgtcggtcctccgaacggtaccagtcgtgtacgactactaccaagttccgacctagtccncctactccctcctgtctcnctatcgtagtaggaagtaccagtactaccactactaccgtacgttcgggacccggacgttacgaccgacggtacctacgtaccgacgtaccggttaacttttccggtaacggtccggttacggttacgtacgtaacgaaaccgtaaaccgggtaaacgggccgggtaacccgtacccgtaccgtacgtaaggttacgttcggtaacgtttacagtccggtacgtacaccgtacgagttacgcggacgggttaggcccggtacctagtacccggtaaggtacgtggacgaacgtgtcccgaggtaagtcggaaccgtaataaccgtacttaccgtactacgtactacgttagacctacggcctaacgtacgtacgtacgtaccgtaacggttaagttactttaacggtaactttaacgttactttaacaaccgttaacgtaacgtaatttaccgtagtaaccctaccggtactacggtacgtaccgtaccgggaacgtaacgggtaacgtaggtaacgtacgaacccggtaaagtcggtaggtctacgtcgtaaccgg

SEQ ID NO: 215517 - DNA, 889 bp, Homo sapiens
  misc_feature: GYAE6OF01A2GJ1.1.34.D01.1.454.CMB.1.raw
  modified_base (104)..(104): a, c, t, g, unknown or other
  misc_feature (104)..(104): n is a, c, g, or t
  modified_base (357)..(357): a, c, t, g, unknown or other
  misc_feature (357)..(357): n is a, c, g, or t
tcagacgagtgcgtcacgaccggtgctcgatttagatcgtctgtgttggggtttgggggagtcagaccctgtcaggacacagcatggacatggacgggtccccnctcagctccgtggggctcctgctgcctctcggcctcccaggtaccagctgtagactataccaagttcgacctacgtcctccactccctcctgtctgctatctagtaggacacgagtacgtcaccgtactccgtacgttcgggacccgggtctaggtaccacggccagtaccggaacggtccgttatttaccgtttacggtccggttggggtacaccgacggaaccgaaaccggaacccggtacggggtacccnccccggtaacccccgtaggaacgtaacgttccggtttaacggttacgttaggtcggtacgtaaccctacgttacccggtaaggtttacggttacccgggaaacgggttaccgggggggttaaccccggtccctaaaccgggtttacccgggtacggtttaaccggtagggtaccgggttaccgtaacgggttcgtaacccgtaacccggttagggaaaccggtaacgttaccggttaaccttaacccggtaccttaccgtactaacgtcccgtaagaccgttacgaccgtacgtccgaccgttagaaccgttagtactttaactacgtttagttaacctttactacgtaacgtacgttaacttacggtaacctttaaccggttacccggttaccgggttaaacggtttaccggggtacccgggttaacccggaaaccgggggttaaacccgggtacgggtaaaccgggttaccggaaaacgttcccccgggtaaaattcgggtaccggtcccggtaaacgtccgtaacccgg

SEQ ID NO: 215518 - DNA, 458 bp, Homo sapiens
  misc_feature: GYAE6OF01A1C8Z.1.34.D01.1.454.CMB.1.raw
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (432)..(458): a, c, t, g, unknown or other
  misc_feature (432)..(458): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccagttcagtggcagtgcatctgggacagattacactctcactatcagcagcctgcagcctgaagtattttgacttaatttattactgtacaaatagtattaatacgtaccccgtagtcggacgttcggccgtaagggggacctaagggtacgtaaagtccgaaacccgaagttcggtagggccttgacaccgtattcgtcgtcttcatccttccccgctatccgtnaaccgctacgcgttntacggngcggtactggacgagcgactatagcnnnnnnnnnnnnnnnnnnnnnnnnnnn

SEQ ID NO: 215519 - DNA, 704 bp, Homo sapiens
  misc_feature: GYAE6OF01DZX66.1.34.D01.1.454.CMB.1.raw
  modified_base (454)..(454): a, c, t, g, unknown or other
  misc_feature (454)..(454): n is a, c, g, or t
  modified_base (502)..(502): a, c, t, g, unknown or other
  misc_feature (502)..(502): n is a, c, g, or t
  modified_base (517)..(517): a, c, t, g, unknown or other
  misc_feature (517)..(517): n is a, c, g, or t
  modified_base (550)..(550): a, c, t, g, unknown or other
  misc_feature (550)..(550): n is a, c, g, or t
tcagacgagtgcgtcacgaccggtgctcgatttagatcgtctgtgttgggtttgggggagtcagaccctgtcaggacacgagcatggacatgacgggtccccgctcagctccgtcggggctcctgctgctcgtcggcctcccaggtaccagcctgtgacactaccaattcgaccacgtctccactcctccctgtactgctatcgtattaggacacgagtacgtccaccactccacgttccgggccgggcgacgtcgacggccactacgagcgttaactttccgttacggtccgttacggttcgaccgtagacgaaacggaaacccggcgggtaccaccggcccgtacgagtacgtccgtcgtaacgtgtcggtacgtctagtacgagtcgttacggacggttacgggtccggtcctaagtccgtaggtcgtagtcgagacgtcgactgtaccgnggaactagtacgttcactcttacgctacgacgtacgacgtccgcgttnacccgtacgtacgtnttaacggttcttagttaccttttaagtttaccngttaacctaacgttaattaccgtttaataacccgtttccgaaccgttcgggttaaccgggccggttaaccggacccgggtaagggttaacggacgggttaaacccgggtaccgaaaccgttaccggtaagggttcggactaaggtcccgtaccg

SEQ ID NO: 215520 - DNA, 672 bp, Homo sapiens
  misc_feature: GYAE6OF01C9Q97.1.34.D01.1.454.CMB.1.raw
  modified_base (104)..(104): a, c, t, g, unknown or other
  misc_feature (104)..(104): n is a, c, g, or t
  modified_base (373)..(373): a, c, t, g, unknown or other
  misc_feature (373)..(373): n is a, c, g, or t
  modified_base (513)..(513): a, c, t, g, unknown or other
  misc_feature (513)..(513): n is a, c, g, or t
  modified_base (657)..(657): a, c, t, g, unknown or other
  misc_feature (657)..(657): n is a, c, g, or t
  modified_base (665)..(665): a, c, t, g, unknown or other
  misc_feature (665)..(665): n is a, c, g, or t
tcagacgagtgcgtcacgaccggtgctcgatttagatcgtctgtggttgggtttgggggagtcagaccctgtcaggacacagcatggacatggacgggtccccnctcagctccgtgggctcctgctgctcgtcggcctacccgaggtaccagtctagtacgacactaccgtaattcgaccctagttccaccctactccccttccctcgtcctagctacttatagtggagaccgagactaccaccctagtctaccggttacgggccgggacgagtaccggacgaccctattacgacgtacgttacttttcgttacggtccgttgggtacgacgaacgacgaacgtaaccgggacgggtaccgaacctcccgtanacgtacgtcgttagtccgtggttcgacgtacactacgaaggttgtacggacggtacgggtccggtacctacgtacggtggtgaggtcggatgggtatcgtaacgtcggaacgtacgtactactacgccttacgacttacngtccgatccgagccagcgtcgtactgtaaagttgttataactttaagtttactacaccgttaatcgttaattaacgttacgaccgttacgtcggccgtaaggtcccggacggaggtacggtcaacggacgtacgtaagttacgngtacgtcngtacccg

SEQ ID NO: 215521 - DNA, 1052 bp, Homo sapiens
  misc_feature: GYAE6OF01BGQGY.1.34.D01.1.454.CMB.1.raw
tcagacgagtgcgtcacgaccggtgctcgatttagatcgtctgtggttgggtttgggggagtcagaccctgtcaggacacagcatggacatgacggggtcccgctcagctcctggggctccgtgctgctctggctccgaggtaccagctgtcgactataccaattcgacctagtcctccattcctccctgtctcgcattctagttcggagacagagtccactactctaccgttcgggccgggcgtagtacgacggcatcgaggcgttacgtttcgtttaacgtccgttagggttacgtaccgaacggaccgaaacggaaaaccccggacgggggaacccggtaacccggtaccccccgtaacggttaacggttaaccgtttaccggggtttaacggtaccgttttaacggttacgggggtaacctaaccgttaaccgtttaaccggtaacggtttaacggtttaacgggtaaccggggttaaacgggggggtttaccccgggggtttaacccctaacccgttttaacccggggggttaacgggtttaacccgggtttaacggggtaaacgggggtaccctaaacggggtttccgggtaaaccggttaccgggttttaaacccgggtttaaggggggtaaaccgttaaacgggttttaacccggtttaaaacccttaccccgtttaaccgtttaacccttaacgtttaaaccccgttcggttaaaccgtaccgggtaaacccgttccgttaaccgggtacgtaacccgtttacggttaacggtttaaaacgtttacggttttttaacggtaacctttttaaaacgttttaccgtttaacccgggtttaattaaccgttaaacgtttaacgttttaaaccggtttaaccttttaaaccccgggtttaaccccggtttacgggttaacccggggtttacccggggttaacccgggaaccggggttaaccggggtaacgggtaaaccgggggttaacgtaaaccggttaacccgttaaacgggtaccgttaaggggtcgacccggttgtaaccccg

SEQ ID NO: 215522 - DNA, 184 bp, Homo sapiens
  misc_feature: GYAE6OF02H3U8R.1.34.D01.1.454.CMB.1.raw
  modified_base (169)..(184): a, c, t, g, unknown or other
  misc_feature (169)..(184): n is a, c, g, or t
tcagacgagtgcgtcacgaccggtgctcgatttagatcgtctgtgttgggtttggacggttcggccagtggaccaaggtggaagtcaaccgaactgtggctgcaccatctgtcttcatcttcccgccatctgaacgcactcgtctgagcgggctggcaaggcgcatagnnnnnnnnnnnnnnnn

SEQ ID NO: 215523 - DNA, 388 bp, Homo sapiens
  misc_feature: GYAE6OF02G5N4B.1.34.D01.1.454.CMB.1.raw
  modified_base (384)..(388): a, c, t, g, unknown or other
  misc_feature (384)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttccgccatctgaacgcactcgtctgagcgggctggcaaggcgcatagnnnnn

SEQ ID NO: 215524 - DNA, 387 bp, Homo sapiens
  misc_feature: GYAE6OF02FMAQ5.1.34.D01.1.454.CMB.1.raw
  modified_base (382)..(387): a, c, t, g, unknown or other
  misc_feature (382)..(387): n is a, c, g, or t
tcagacgagtgcgtcacgaccggtgctcgatttagatcgtctgtgttgggtttgggagtcaggccatcagcgattctttagcctggttgcagcagaaaccagggcgagccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgcctcctcacgcactcgtctgagcgggctggcaaggcgcatagnnnnnn

SEQ ID NO: 215525 - DNA, 385 bp, Homo sapiens
  misc_feature: GYAE6OF02G2BP5.1.34.D01.1.454.CMB.1.raw
  modified_base (382)..(385): a, c, t, g, unknown or other
  misc_feature (382)..(385): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttccgccatctgaacgcactcgtctgagcgggctggcaaggcgcatagnnnn

SEQ ID NO: 215526 - DNA, 390 bp, Homo sapiens
  misc_feature: GYAE6OF02H8LPP.1.34.D01.1.454.CMB.1.raw
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattcctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggcaggggaccaaggtggaagtcaaccgaactgtggctgcaccatctgtcttcatcttccgcatctgaacgcactcgtctgagcgggctggcaaggcgcatagnnnnnnnn

SEQ ID NO: 215527 - DNA, 407 bp, Homo sapiens
  misc_feature: GYAE6OF02FX1AI.1.34.D01.1.454.CMB.1.raw
  modified_base (387)..(387): a, c, t, g, unknown or other
  misc_feature (387)..(387): n is a, c, g, or t
  modified_base (393)..(407): a, c, t, g, unknown or other
  misc_feature (393)..(407): n is a, c, g, or t
tcagacgagtgcgtcacgaccggtgctcgatttagatcgtctgtgttgggtttgggagtcaggccatcagccgattcctttagcctggttgcagtcagaaaccagggcgagcccctcagatcgtagtctatggtgcatccagtattgcaaggtgggtccctatccaggttcagttaggcagtgcatctgggacagattacactctcacgtatcagcagcctggcagcctgaagattttgcaatttatactgtcaactagtatttatagtaccccttacgtggacttcggccaggggaccaaggtggaaggtcaaccgaactgtggctgcaccatctgtcttcatcttcccacctctcacgcactcgtctgagcgggctggcaaggcncatagnnnnnnnnnnnnnnn

SEQ ID NO: 215528 - DNA, 391 bp, Homo sapiens
  misc_feature: GYAE6OF02HOUNO.1.34.D01.1.454.CMB.1.raw
  modified_base (386)..(391): a, c, t, g, unknown or other
  misc_feature (386)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccaccctcctcacgcactcgtctgagcgggctgggcaaggcgcatagnnnnnn

SEQ ID NO: 215529 - DNA, 486 bp, Homo sapiens
  misc_feature: GYAE6OF02IUX1O.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaacagttatatagtaccctagtgacgttcggccagggaccaaggtggaagtacgaacgactgtcggctgacc

SEQ ID NO: 215530 - DNA, 388 bp, Homo sapiens
  misc_feature: GYAE6OF02IYUBS.1.34.D01.1.454.CMB.1.raw
  modified_base (380)..(388): a, c, t, g, unknown or other
  misc_feature (380)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgactgtggctgcaccatctgtctcatcttcccacctcctcacgcactcgtctgagcgggctggcaaggcgcatagnnnnnnnnn

SEQ ID NO: 215531 - DNA, 486 bp, Homo sapiens
  misc_feature: GYAE6OF02I5ZTS.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgactaatttattactgtcaacagtaattatagtacccctacgtgacgttcggccagggaccaaggtggaagtcaaccgaactgtggctgacc

SEQ ID NO: 215532 - DNA, 389 bp, Homo sapiens
  misc_feature: GYAE6OF02HD7RM.1.34.D01.1.454.CMB.1.raw
  modified_base (383)..(389): a, c, t, g, unknown or other
  misc_feature (383)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcctcctcacgcactcgtctgagcgggctggcaaggcgcatagnnnnnnn

SEQ ID NO: 215533 - DNA, 481 bp, Homo sapiens
  misc_feature: GYAE6OF02G41Q8.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtcaactagtattatacgtaccctagtgacgttcggcagggaccaaggtgaagtcaacgactgtggctgac

SEQ ID NO: 215534 - DNA, 387 bp, Homo sapiens
  misc_feature: GYAE6OF02GLTIN.1.34.D01.1.454.CMB.1.raw
  modified_base (381)..(387): a, c, t, g, unknown or other
  misc_feature (381)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttccacctctcacgcactcgtctgagcgggctggcaaggcgcatagnnnnnnn

SEQ ID NO: 215535 - DNA, 390 bp, Homo sapiens
  misc_feature: GYAE6OF02F4U2U.1.34.D01.1.454.CMB.1.raw
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgcatctgaacgcactcgtctgagcgggctggcaaggcgcatagnnnnnnn

SEQ ID NO: 215536 - DNA, 387 bp, Homo sapiens; identical to SEQ ID NO: 214360
  misc_feature: GYAE6OF02F1C7A.1.34.D01.1.454.CMB.1.raw
  modified_base (383)..(387): a, c, t, g, unknown or other
  misc_feature (383)..(387): n is a, c, g, or t

SEQ ID NO: 215537 - DNA, 387 bp, Homo sapiens
  misc_feature: GYAE6OF02I5F0K.1.34.D01.1.454.CMB.1.raw
  modified_base (374)..(374): a, c, t, g, unknown or other
  misc_feature (374)..(374): n is a, c, g, or t
  modified_base (380)..(387): a, c, t, g, unknown or other
  misc_feature (380)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatctccgcatctgaacgcactcgtctgagcggctggcaaggcncatagnnnnnnnn

SEQ ID NO: 215538 - DNA, 509 bp, Homo sapiens
  misc_feature: GYAE6OF02I7NEH.1.34.D01.1.454.CMB.1.raw
  modified_base (502)..(502): a, c, t, g, unknown or other
  misc_feature (502)..(502): n is a, c, g, or t
tcagacgagtgcgtcacgaccggtgctcgatttagatcgtctgtgttggggtttgggggagtcagaccctgtcaggacacagcatggacatgacgggtcccgctcagctcctgggctcctgctgctctggctcccaggtaccagctgtgacatccaattgacccagtctccatcctcctgtctgcatctattggagacgagagtcaccatcacttgccgggcagtcaggccatcagcgatctttagcctggttgcagcagtaaaccagggcaagcccctcgagatcgtagtcctatggtggcatccagattggcaaggtgggtcccatccaggttcagtgcagtcgcatctgggacagattacgactcgtcactatcagcagcctgcagctgaagtactttgactaatttacttactgttcaatagtattagtacgtaccctagtcggtacgttcggcgtagggaccaaggtcggaagtcgaaccggtaaccgtggtacggntggaccg

SEQ ID NO: 215539 - DNA, 488 bp, Homo sapiens
  misc_feature: GYAE6OF02I812M.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaacgtattttgctaatttattactgtcaactagttattattacgtacccttagtcgtacgttcgcgagggaccaaggtgaagtcaacgactgtggctgacc

SEQ ID NO: 215540 - DNA, 390 bp, Homo sapiens
  misc_feature: GYAE6OF02ICDFT.1.34.D01.1.454.CMB.1.raw
  modified_base (377)..(377): a, c, t, g, unknown or other
  misc_feature (377)..(377): n is a, c, g, or t
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgcatctgaacgcactcgtctgagcgggctggcaaggcncatagnnnnnnnn

SEQ ID NO: 215541 - DNA, 403 bp, Homo sapiens
  misc_feature: GYAE6OF02IRFGU.1.34.D01.1.454.CMB.1.raw
  modified_base (384)..(403): a, c, t, g, unknown or other
  misc_feature (384)..(403): n is a, c, g, or t
tcagacgagtgcgtcacgaccggtgctcgatttagatcgtctgtgttgggtttggggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatacgtacccctagtggacttcggccagggggaccaaggtggaagtcaacgaactgtggctgcaccatctgtcttcatcttccgccatctgaacgctactcgtctgagcggtctggcaaggcgcatagnnnnnnnnnnnnnnnnnnnn

SEQ ID NO: 215542 - DNA, 388 bp, Homo sapiens
  misc_feature: GYAE6OF02G4YRZ.1.34.D01.1.454.CMB.1.raw
  modified_base (383)..(388): a, c, t, g, unknown or other
  misc_feature (383)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgccctctcacgcactcgtctgagcgggctggcaaggcgcatagnnnnnn

SEQ ID NO: 215543 - DNA, 479 bp, Homo sapiens
  misc_feature: GYAE6OF02GSMLP.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtatttgctaatttattactgtacaactagtattatagtacccctagtggacgttcggccaggggaccaggtgaagtcacgactgtggctgcaccatctgtcttcatcctccgc

SEQ ID NO: 215544 - DNA, 391 bp, Homo sapiens
  misc_feature: GYAE6OF02FQ8M4.1.34.D01.1.454.CMB.1.raw
  modified_base (385)..(391): a, c, t, g, unknown or other
  misc_feature (385)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccaccctcctcacgcactcgtctgagcgggctggcaaggcgcatagnnnnnnn

SEQ ID NO: 215545 - DNA, 585 bp, Homo sapiens
  misc_feature: GYAE6OF02IAELS.1.34.D01.1.454.CMB.1.raw
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgtttggggtttggggagtcagaccctgtcaggacacagcatggacatgagggtccccgctcagcttcctgggctcctgctgctctggctcccaggtaccagctgtgacatccaattgacccagtctccatcctcctgtctgcatctattggagacagagtcaccatcacttgccgggcagtcacggccatcgagcggattcttacgccgtggttncagcaagaaaccgagggcagcccctanaggatcgtagtctatcggtcgcaatccgagtacttgacaaggggtcgggtcccatccgaggttcaggtcggctaggtgcactcgtgggacagacttacactctacacttatctagcagcctgactacgccttagaatattttgacgttaaatttattactgtactaacgtacttaattacgttaaccgtacccgttacggtacggttaccggttaccggaccggtaaccggggtaacctaacggggttacgtaaaccggttaccgaaacccggtaccgttaggtcggtacctaggaccc

SEQ ID NO: 215546 - DNA, 418 bp, Homo sapiens
  misc_feature: GYAE6OF02I8GIC.1.34.D01.1.454.CMB.1.raw
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (388)..(418): a, c, t, g, unknown or other
  misc_feature (388)..(418): n is a, c, g, or t
tcagacgagtgcgtcacgaccggtgctcgatttagatcgtctgtgttgggtttgggagtcaggccatcagcgattctttagccctggttgcagcaggaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattaatagtacccctagtggacgttcgccaggggaccaaggtggaagtcaaccgactgtcggctgcacatctgtcttcatcttcccgcatctgaacgcactcgtntgacgcgggctggacaaggcncatagnnnnnnnnnnnnnnnnnnnnnnnnnnnnnnn

SEQ ID NO: 215547 - DNA, 479 bp, Homo sapiens
  misc_feature: GYAE6OF02IJI9Z.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaacagttatatagtaccctagtgacgttcggcagggacaaggtggaagtcaacgactgtgctgc

SEQ ID NO: 215548 - DNA, 472 bp, Homo sapiens
  misc_feature: GYAE6OF02H335S.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagctgcagcctgaagatttgctaatttattactgtcaacagtatatagtaccctagtgacgttcggaccagggaccaaggtgaagtcaacgactgtgctgcacatctgtcttcatcctccgcc

SEQ ID NO: 215549 - DNA, 490 bp, Homo sapiens
  misc_feature: GYAE6OF02H01G3.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttgctaatttattacttgtacaactagtatatagtaccctagtggacgtttcggccaggggaccaaggtggaagtcaacgaactggtggctgcaccatctgtcttcacttcctccctaccc

SEQ ID NO: 215550 - DNA, 502 bp, Homo sapiens
  misc_feature: GYAE6OF02IZG75.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaaattttattactgtacaactagtattatacgttaccctacgtcggtacgttcggaccgaggggaccaaggtaggaagtacaaccgactggtggctgcaccatctgtcttcacttcctccctaccc

SEQ ID NO: 215551 - DNA, 392 bp, Homo sapiens
  misc_feature: GYAE6OF02IR73P.1.34.D01.1.454.CMB.1.raw
  modified_base (385)..(392): a, c, t, g, unknown or other
  misc_feature (385)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccagggggaccaaggtggaagtcaaccgaactgtggctgcaccatctgtcttcatcttcccgccctcctcacgcactcgtctgagcgggctggcaaggcgcatagnnnnnnnn

SEQ ID NO: 215552 - DNA, 509 bp, Homo sapiens
  misc_feature: GYAE6OF02F1M0U.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagtattacactctacactatcagcagcctgcagcctagaagtattttgacttaatttattactgttacaactagttattatacgtacccctagtcggacgttcggacgaggggaccaagggtcggaagtcaaccggtaacgtggtacggctagcc

SEQ ID NO: 215553 - DNA, 478 bp, Homo sapiens
  misc_feature: GYAE6OF02GPBA8.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagatttgctaatttattactgtcaacagtattatagtaccctagtggacgttcggccaggggaccaaggtgaagtcacgactgtggctgcacatctgtcttcatctcccaccc

SEQ ID NO: 215554 - DNA, 520 bp, Homo sapiens
  misc_feature: GYAE6OF02G7ST9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcaaggtgggtcccatccgaggttcagtggcagtgcatcgtgggacagattacactctcactatcagcagcctgcagcctagaagtattttgactaaagttactattgtacaacagaccaaactacgtttccctacgtacgttcggaccgaaacgggaccaaaggtacggaaaaccgaaacgaacgtacggtaggcgtacgaccactacg

SEQ ID NO: 215555 - DNA, 388 bp, Homo sapiens
  misc_feature: GYAE6OF02F0FLV.1.34.D01.1.454.CMB.1.raw
  modified_base (376)..(376): a, c, t, g, unknown or other
  misc_feature (376)..(376): n is a, c, g, or t
  modified_base (382)..(388): a, c, t, g, unknown or other
  misc_feature (382)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacttcggccaggggaccaaggtggaagtcaaccgaactgtggctgcaccatctgtcttcatcttccacctcctcacgcactcgtctgagcgggctggcaaggcncatagnnnnnnn

SEQ ID NO: 215556 - DNA, 484 bp, Homo sapiens
  misc_feature: GYAE6OF02GJ4U8.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaacagtattatagtaccctagtggacgttcggccagggaccaaggtggaagtcaaccgaactgtggctgacc

SEQ ID NO: 215557 - DNA, 479 bp, Homo sapiens
  misc_feature: GYAE6OF02GEVQS.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagatttttgctaatttattactgtcaactagtattatagtaccctagtggacgttcggcagggaccaaggtgaagtcaacgactgtgctgac

SEQ ID NO: 215558 - DNA, 489 bp, Homo sapiens
  misc_feature: GYAE6OF02IGP7R.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctagaagtattttgactaatttattactgtacaactagttattatacgtaccctagtgtacgttcggcgagggacaaggtgaagtcaacgactggtcgctgac

SEQ ID NO: 215559 - DNA, 408 bp, Homo sapiens
  misc_feature: GYAE6OF02G8FF5.1.34.D01.1.454.CMB.1.raw
  modified_base (374)..(374): a, c, t, g, unknown or other
  misc_feature (374)..(374): n is a, c, g, or t
  modified_base (380)..(408): a, c, t, g, unknown or other
  misc_feature (380)..(408): n is a, c, g, or t
tcagacgagtgcgtcacgaccggtgctcgatttagatcgtctgtggtttggggtttgggagtcaggccatcagcgattctttagcctggttgcagcagaaaccaggcgagccctcagatcgtagtctatggtgcatccagtattgcaaggtggggttcccatccaggttcagtggcagtgcatctggggacagattacactctcactatcagcagcctgctagcctgaagattttgcaatttattactgtcaacagtattatagtacccctacgtgacgttcggccaggggaccaaggtgaagtcaacgatgtgctgcacatctgtcttcatctccgcatctgaacgcactcgtctgagcggctgggcaaggcncatagnnnnnnnnnnnnnnnnnnnnnnnnnnnnn

SEQ ID NO: 215560 - DNA, 503 bp, Homo sapiens
  misc_feature: GYAE6OF02G0PS6.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctgaagtattttgactaatttattactgtacaactagttattataacgtaccctagtcggtacgttcggccgtaggggaccaaggtggaacgtcaaccggtacgttggtcggtctgacc

SEQ ID NO: 215561 - DNA, 498 bp, Homo sapiens
  misc_feature: GYAE6OF02JBCBK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttattaatacgtaccctacgtcggtacgttcgggcctaggggaccaagggtgaagtcgaaccgaactggtggctgac

SEQ ID NO: 215562 - DNA, 484 bp, Homo sapiens
  misc_feature: GYAE6OF02F7HJC.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttgctaatttattactgttacaactagtattatacgtacccctagtgacgttcggccaggggaccaaggtgaagtcacgactgtggctgcacatctgtcttcatcctccctccc

SEQ ID NO: 215563 - DNA, 388 bp, Homo sapiens
  misc_feature: GYAE6OF02F3ZVB.1.34.D01.1.454.CMB.1.raw
  modified_base (382)..(388): a, c, t, g, unknown or other
  misc_feature (382)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcggccaggggaccaaggtgaagtcaaccgaactgtggctgcaccatctgtcttcatcttcccgccatctgaacgcactcgtctgagcgggctggcaaggcgcatagnnnnnnn

SEQ ID NO: 215564 - DNA, 495 bp, Homo sapiens
  misc_feature: GYAE6OF02GYHSO.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtattttgactaatttattactgtacaatagtattatacgtaccctagtggtacgttcggcctagggaccaaggtacggaagtcgaaccgactggtggtctgac

SEQ ID NO: 215565 - DNA, 485 bp, Homo sapiens
  misc_feature: GYAE6OF02I1W3N.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtcaactagtattatacgtaccctacgtgacgttcggccagggaccaaggtgaagtcaacgactgtggctgacc

SEQ ID NO: 215566 - DNA, 510 bp, Homo sapiens
  misc_feature: GYAE6OF02JZ8ID.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtcgggtcccatccaggttcagtggcagtgcatcgtgggacagattacactctcactatcagcagcctgcagcctagaagtattttgactaatttattactgtactaactagttattataacgttacccctaggtcggtacgttcggcgaagggaccgtaagggtgaacgtacaaccggaacttggacggtctgtaccg

SEQ ID NO: 215567 - DNA, 487 bp, Homo sapiens
  misc_feature: GYAE6OF02JBVH7.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttgactaatttattactgtacaactagtattatacgtaccctacgtggacgttcggccgaggggaccaggtgaagtcacgactgtggctgcaccatctgtcttcacttcctcccgtc

SEQ ID NO: 215568 - DNA, 474 bp, Homo sapiens
  misc_feature: GYAE6OF02IEE4L.1.34.D01.1.454.CMB.1.raw
  modified_base (255)..(255): a, c, t, g, unknown or other
  misc_feature (255)..(255): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctgaagtatttgctaatttattactgtacaactagtattaatagtaccctagtgacgttcgcgagggcaaggtgaatcacgatgngctgcacntctgtcttcatcctcccgtccc

SEQ ID NO: 215569 - DNA, 393 bp, Homo sapiens
  misc_feature: GYAE6OF02HGN6W.1.34.D01.1.454.CMB.1.raw
  modified_base (368)..(368): a, c, t, g, unknown or other
  misc_feature (368)..(368): n is a, c, g, or t
  modified_base (384)..(393): a, c, t, g, unknown or other
  misc_feature (384)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaacagtattatagtacccctacgtggacgttcggccaggggaccaaggtggaagtcaaccgaactgtggctgcaccatctgtcttcatcttcccgcatctgaacgcactcgtctgagcgggntggcaaggcgcatagnnnnnnnnnn

SEQ ID NO: 215570 - DNA, 495 bp, Homo sapiens
  misc_feature: GYAE6OF02F9I99.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcacgcctgcagcctagaacgtattttgacttaatttattactgtacaactagttattatacgtaccctagtcggacgttcggcgagggacaaggtggaagtcaacgactgtcggctgacc

SEQ ID NO: 215571 - DNA, 492 bp, Homo sapiens
  misc_feature: GYAE6OF02I1H3K.1.34.D01.1.454.CMB.1.raw
  modified_base (393)..(393): a, c, t, g, unknown or other
  misc_feature (393)..(393): n is a, c, g, or t
  modified_base (488)..(488): a, c, t, g, unknown or other
  misc_feature (488)..(488): n is a, c, g, or t
tcagacgagtgcgtcacgaccggtgctcgatttagatcgtctgtgttgggtttgggggagtcagaccctgtcaggacacagcatggacatgagggtacccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgctaatttattactgtacaacagttattataacgtaccccttagtcgtacgttcggccaggggaccaaggtggaagtcaaccgatgtcggntgac

SEQ ID NO: 215572 - DNA, 389 bp, Homo sapiens
  misc_feature: GYAE6OF02F8ZFV.1.34.D01.1.454.CMB.1.raw
  modified_base (377)..(377): a, c, t, g, unknown or other
  misc_feature (377)..(377): n is a, c, g, or t
  modified_base (383)..(389): a, c, t, g, unknown or other
  misc_feature (383)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgagacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccacctctcacgcactcgtctgacgcgggctggcaaggcncatagnnnnnnn

SEQ ID NO: 215573 - DNA, 491 bp, Homo sapiens
  misc_feature: GYAE6OF02G8IUR.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaactagtattatagtaccctacgtggacgttcggccgagggaccaaggtaggaagtacaaccgaactgtaggtctgacc

SEQ ID NO: 215574 - DNA, 390 bp, Homo sapiens
  misc_feature: GYAE6OF02HL52G.1.34.D01.1.454.CMB.1.raw
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccacctcctcacgcactcgtctgagcgggctggcaaggcgcatagnnnnnnnn

SEQ ID NO: 215575 - DNA, 485 bp, Homo sapiens
  misc_feature: GYAE6OF02JCL0E.1.34.D01.1.454.CMB.1.raw
  modified_base (389)..(389): a, c, t, g, unknown or other
  misc_feature (389)..(389): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgtaaggtgggtcccatccaggttcagtgcagtgcatctgggacagattacactctcactatcagcagcctgcagcctgaagnttttgctaatttatactgtacaactagttattatagtacccctagtagacgttcggcaggggaccaagggtgaagtcaaccgatgtaggctgctac

SEQ ID NO: 215576 - DNA, 395 bp, Homo sapiens
  misc_feature: GYAE6OF02I6WO6.1.34.D01.1.454.CMB.1.raw
  modified_base (347)..(347): a, c, t, g, unknown or other
  misc_feature (347)..(347): n is a, c, g, or t
  modified_base (383)..(395): a, c, t, g, unknown or other
  misc_feature (383)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtaccctacgtggacgttcggccaggggaccaaggtgaagtcaaccgaactgtggctgcaccatctgtctcatcttcccgcatctgaacncactcgtctgagtcgggctggccaaggcgcatacgnnnnnnnnnnnnn

SEQ ID NO: 215577 - DNA, 494 bp, Homo sapiens
  misc_feature: GYAE6OF02HXQ2P.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtcaactagttattactagtaccctagtggacgttcggcctaggggaccaaggtggaagtcgaacgaactggtcggctgacc

SEQ ID NO: 215578 - DNA, 706 bp, Homo sapiens
  misc_feature: GYAE6OF02H5PD1.1.34.D01.1.454.CMB.1.raw
  modified_base (126)..(126): a, c, t, g, unknown or other
  misc_feature (126)..(126): n is a, c, g, or t
  modified_base (137)..(137): a, c, t, g, unknown or other
  misc_feature (137)..(137): n is a, c, g, or t
  modified_base (142)..(142): a, c, t, g, unknown or other
  misc_feature (142)..(142): n is a, c, g, or t
  modified_base (150)..(150): a, c, t, g, unknown or other
  misc_feature (150)..(150): n is a, c, g, or t
  modified_base (153)..(153): a, c, t, g, unknown or other
  misc_feature (153)..(153): n is a, c, g, or t
  modified_base (159)..(159): a, c, t, g, unknown or other
  misc_feature (159)..(159): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacncactatccacntcacnctcctctntcncgactntcttagtggacacagtcaccactactacttacgtcgggccgggagtacgtacggaccggacctactacgacggacgttactttttacgttaccgtccggtttgggttcgacgacgacgaaaccgaaaaccgggcggggacgaccccgtcccctagaacgtacgttacggttacttacttagggttggtcgacttacctaccgaagtttgtcgaacggtagggggttcccgggacctactacgggtacgttacgagggtcgactaggtcactacttcgggacggaacaagttactaacctcctctactacttacacgactacgacgtcgtcgacgcgtcgtaagaagttttgttcgaattttaatttactcgttcgtaaacaacgttattaacttagttacccgtacccgttaggtacggttaccggttccgaacgggtaacggaacggtagggtacgtaacgaaccgaaccgtacgttgggacgtcgtacgaacccgtaactagttcgttacgttccttaacgtacttttacccccgcccgtaaccg

SEQ ID NO: 215579 - DNA, 493 bp, Homo sapiens
  misc_feature: GYAE6OF02GFTC1.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtattttgacttaatttattactgtactaactagttattatacgtaccctagtgtacgttcggccgagggaccaaggtagaagtacaacgactgtggctgac

SEQ ID NO: 215580 - DNA, 398 bp, Homo sapiens
  misc_feature: GYAE6OF02HC8A8.1.34.D01.1.454.CMB.1.raw
  modified_base (380)..(380): a, c, t, g, unknown or other
  misc_feature (380)..(380): n is a, c, g, or t
  modified_base (384)..(398): a, c, t, g, unknown or other
  misc_feature (384)..(398): n is a, c, g, or t
tcagacgagtgcgtcacgaccggtgctcgatttagatcgtctgtggttggggtttgggagtcaggccatcagcgattctttagcctggttgcagcagaaaccagggccgagcccctcagatcgtagtctatggtgcatccagattggcaaggtggggtcccatccaggttcagtggcagtgcatctgggaccagattacactctcactatcagcagcctgcagcctgaagattttgcaatttattactgtcaacagtattatagtacccctagtggacgttcggccaaggggaccaaggtgaagtcaaccgaactgtggctgcaccatctgtcttcatcttccgcatctgaacgcactcgtctgagcggctggcaaggcnatgnnnnnnnnnnnnnnn

SEQ ID NO: 215581 - DNA, 204 bp, Homo sapiens
  misc_feature: GYAE6OF02F8PWO.1.34.D01.1.454.CMB.1.raw
  modified_base (168)..(204): a, c, t, g, unknown or other
  misc_feature (168)..(204): n is a, c, g, or t
tcagacgagtgcgtcacgaccggtgctcgatttagatcgtctgtgttgggtttggacgttcggccaggggaccaaggtggaagtcaaccgaactgtggctgcaccatctgtcttcatcttcccgccatctgaacgcactcgtctgagcgggctggcaaggcgcatagnnnnnnnnnnnnnnnnnnnnnnnnnnnnnnnnnnnnn

SEQ ID NO: 215582 - DNA, 489 bp, Homo sapiens
  misc_feature: GYAE6OF02HIRSG.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagctgcagcctgaagattttgactaatttattactgtacaacagtattatagtaccctagtggtacgttcggccgagggaccgaaggtggaagtacaccgaactggtgctgcaccatctctcttctactctcccgtccc

SEQ ID NO: 215583 - DNA, 479 bp, Homo sapiens
  misc_feature: GYAE6OF02I3ZQ7.1.34.D01.1.454.CMB.1.raw
  modified_base (467)..(467): a, c, t, g, unknown or other
  misc_feature (467)..(467): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagatttgctaatttattactgtcaacagtattatagtaccctagtggacgttcggccagggaccaaggtgaagtcacgaactgtggctgcaccatctgtcttcntcctcccgtccc

SEQ ID NO: 215584 - DNA, 488 bp, Homo sapiens
  misc_feature: GYAE6OF02JCRMQ.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagatttgctaatttattactgtacaacagttatatagtacccctagtcggacgttcggccgaggggaccaaggtggaagtcacgaactgtggctgccacatctgtcttcactcctccctaccc

SEQ ID NO: 215585 - DNA, 475 bp, Homo sapiens
  misc_feature: GYAE6OF02JINX1.1.34.D01.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttggggagtcagaccctgtcaggacacagcatggacatgagggtccccgctcagctcctggctcctgctgctctggctcccaggtaccagctgtgacatccaattgacccagtctccactcctccctgtctgcatctattggagacagagtcaccanttcaccgttgccgggcgagtcaggccatcagcngacttctttagcctggttgcaagcgagaaaccacggcgagccctcagatcgtagtctatggtgcatcagagttggcaaggtgggtccgactccgaggtcagtggcagtgcgatcgtggacagattacactactcactatacacgacacgacctcgcagcctagaagtaattttanggttacgtaacgtttaactttaacttacgttacgtaacgtaacgttacttaagttaacg

SEQ ID NO: 215586 - DNA, 388 bp, Homo sapiens
  misc_feature: GYAE6OF02HEYAG.1.34.D01.1.454.CMB.1.raw
  modified_base (382)..(388): a, c, t, g, unknown or other
  misc_feature (382)..(388): n is a, c, g, or t
tcagacgagtgcgtcacgaccggtgctcgatttagatcgtctgtgttgggtttggtagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactgtctgagcgggctggcaaggcgcatagnnnnnnn

SEQ ID NO: 215587 - DNA, 663 bp, Homo sapiens
  misc_feature: GYAE6OF02J3AVC.1.34.D01.1.454.CMB.1.raw
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggggagtcagaccctgtcaggacacagcatggacatgagggtcccgctcagctcctggggctcctgctgctctggctcccaggtaccagctgtgacatccaattgacccagtctccatcctcctgtctgcatctattggagacagagtcaccatcacgttgccgggcagtcaggccatcagcgtattcttagcctggtgcagcagaaccnggcacgcccctnagtatcgtagtctagtggtcncatccagtacgttacgcgtaagggtcgggtacccagtccgtaaggttcgaggtcggactaggttcgcgtagtcggtagggactagtacttaccgacttctactacttacgtcgacgtccaacgccttaggacctacggtacccgttaaggtaacgtttacttttacggaacctttaaagttttacgttaaccgtttacggtaacctaaacgtttaagtttaaacctttacgttaacccggttaccccgtaacggggttacggtaccggtttcccggggaacccggtaacggggtaaacccgtaaggggtacggtaaaccgtacccggtaaccggttaacgttcggtaccggacgttacgtaacccg

SEQ ID NO: 215588 - DNA, 395 bp, Homo sapiens
  misc_feature: GYAE6OF02ITMH2.1.34.D01.1.454.CMB.1.raw
  modified_base (386)..(395): a, c, t, g, unknown or other
  misc_feature (386)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccccctagtggacgttcggccagggggaccaaggtggaagtcaaccgaactgtggctgcaccatctgtcttcatcttcccgccatctgaacgcactcgtctgagcgggctggcaaggcgcatagnnnnnnnnnn

SEQ ID NO: 215589 - DNA, 478 bp, Homo sapiens
  misc_feature: GYAE6OF02HHDQL.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggctgcagcagaaaccagggcgagcccctcagatcgtagtctatggtgcatccagattgcaaggtgggtccatccaggttcagtggcagtgcatctgggacagattacactctcactatcagcagcctgcagcctgaagtattttgactaatttattactgtacaactagtattatagtacccctagtgacgttcggccaggggaccaaggtgagtcaacgacgtggtgctgcacatctgtcttcatctcccg

SEQ ID NO: 215590 - DNA, 392 bp, Homo sapiens
  misc_feature: GYAE6OF02JCK10.1.34.D01.1.454.CMB.1.raw
  modified_base (383)..(392): a, c, t, g, unknown or other
  misc_feature (383)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcattatcagcagcctgcagcctgaagattttgcaatttattactgtcaacagtattatagtacccctagtggacgttcggccaggggaccaaggtggaagtcaaccgaactgtggctgcaccatctgtcttcatcttcccgcctcctcacgcactcgtctgagcgggctggcaaggcgcatagnnnnnnnnnn

SEQ ID NO: 215591 - DNA, 509 bp, Homo sapiens
  misc_feature: GYAE6OF02FQZ3G.1.34.D01.1.454.CMB.1.raw
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcaagaaaccgagggcgacgcccctcagatcgtagtctagtggtgcatccagtattgacgaagggtcgggtcccatccgaggttcaggtggcagtgcatcgtgggacagacttacactctcactatcagcagcctgcagcctagaagtnttttgacttaatttattactgtacaactagttattactacgtaccctagtcgtacgttcggcgacgggaccaaggtagaagtcaacgtatggtcgctgacc

SEQ ID NO: 215592 - DNA, 486 bp, Homo sapiens
  misc_feature: GYAE6OF02F9BBV.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaacagttatatagtaccctacgtgacgttcggccagggaccaaggtggaagtcaaccgaactgtggtctgacc

SEQ ID NO: 215593 - DNA, 519 bp, Homo sapiens
  misc_feature: GYAE6OF02F2ZHG.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaatttacttactgtacaactagttaattactacgttacccctagtcggtacgttcggccgaaggggaaccctaagggtacggaacgtacgaaccggtaacgtggtacggactgaccg

SEQ ID NO: 215594 - DNA, 566 bp, Homo sapiens
  misc_feature: GYAE6OF02G9D6O.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtcgggtcccatccaggttcagtggcagtgcatcgtgggacagattacactctcactatcagcagcctgcagcctagaagtattttgacttaaattttacttacttagtactaactagtttaattaacttaaccgttaccccttaacggttcggtaaccggttttccgggacccggtaagggggaaccctaaggggttacgggtaaacggttacccgaaccggtaacgttgggtacggtaccgttaggacccg

SEQ ID NO: 215595 - DNA, 488 bp, Homo sapiens
  misc_feature: GYAE6OF02G7LJ6.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggtcccatccaggttcagtggcagtgcatctgggacagattacactctcactatcagcagcctgcagcctgaagtattttgctaatttattactgtacaactagttattatacgtaccctagtgacgttcggcgagggaccaaggtggaagtcgaaccgaactggtggctgc

SEQ ID NO: 215596 - DNA, 490 bp, Homo sapiens
  misc_feature: GYAE6OF02GDGYP.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgactaatttacttactgttacaactagttattatacgtaccctagtcgacgttcggccgagggaccaaggtgaagtcgaacgactggtgctgc

SEQ ID NO: 215597 - DNA, 488 bp, Homo sapiens
  misc_feature: GYAE6OF02G1N2T.1.34.D01.1.454.CMB.1.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaaccagggcgagcccctnagatcgtagtctatggtgcatccagattgcaaggtcgggtcccatccaggttcagtggcagtgcatctgggacagattacactctcactatcagcagcctgcagcctgaagtattttgactaatttattactgtacaactagttattatacgtaccctaggtgacgttcggcgagggaccaaggtgaagtcgaacgactggtgctgac

SEQ ID NO: 215598 - DNA, 489 bp, Homo sapiens
  misc_feature: GYAE6OF02F27WW.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctatggtgcatccagattgcaaggtgggtcccatccaggttcagtggcagtgcatctgggacagattacactctcactatcagcagcctgcagcctagaagtatttgacttaatttattactgtacaactagttattatacgttaccctagtaggtacgttcggacgagggacaaggtgaagtacaacgatgtcgctgac

SEQ ID NO: 215599 - DNA, 486 bp, Homo sapiens
  misc_feature: GYAE6OF02GLFI5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtcaactagttattatacgtaccctagtgacgttcggccgagggaccaaggtggaagtcaaccgatgtggctgac

SEQ ID NO: 215600 - DNA, 490 bp, Homo sapiens
  misc_feature: GYAE6OF02I17I6.1.34.D01.1.454.CMB.1.raw
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcagtctgggacagattacactctcactatcagcagcctgcagcctgaagtattttgactaattttattactgtacaactagttaattatacgtacccttagtgacgttcggccgagggacaggtgaagtcaacgtactgnggctgacc

SEQ ID NO: 215601 - DNA, 491 bp, Homo sapiens
  misc_feature: GYAE6OF02H0TVN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaatttattactgtcaactagttattatacgtaccctagtgacgttcggccagggaccaaggtagaagtcaaccgactggtcggctgacc

SEQ ID NO: 215602 - DNA, 483 bp, Homo sapiens
  misc_feature: GYAE6OF02F322J.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaactagtattatagtaccctagtgacgttcggccagggaccaaggtgaagtcaaccgactgtggctgacc

SEQ ID NO: 215603 - DNA, 598 bp, Homo sapiens
  misc_feature: GYAE6OF02JFHD3.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgacgaggggtcgggtccatccgtaggttcgaggtcggacaggtcgctattcggtacgggaacagtaacttaacactcctactaacttatacgacgacacgtcctgacacgtcctaggaactttagtttgacttaaattttactactcgtaaccaagtagtttaattaacgtaaccgttaaccccgttaggttacgggtaccggtttaccggaccggtaacggggaacgtaagggtaaggtaactaaccgaaccgtagtggtcggctgaccaactacgttcgttacgttccttacaccttcccttacccctacccc

SEQ ID NO: 215604 - DNA, 387 bp, Homo sapiens
  misc_feature: GYAE6OF02IE9TU.1.34.D01.1.454.CMB.1.raw
  modified_base (383)..(387): a, c, t, g, unknown or other
  misc_feature (383)..(387): n is a, c, g, or t
tcagacgagtgcgtcacgaccggtgctcgatttagatcgtctgtgttgggtttgggggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccagggaccaaggtggaagtcaaccgactgtggctgcaccatctgtcttcatctcccgcatctgaacgcactcgtctgagcgggctggcaaggcgcatagnnnnn

SEQ ID NO: 215605 - DNA, 490 bp, Homo sapiens
  misc_feature: GYAE6OF02IBWHZ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaacagttatatacgtaccctagtgacgttcggccaggggaccaaggtggaagtcaaccgacgtggtcggctgacc

SEQ ID NO: 215606 - DNA, 802 bp, Homo sapiens
  misc_feature: GYAE6OF02GG12O.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctcgtggcctccgaggtaccagctgtgacactaccaattcgacccagtcctccactccctcctgtctgcatcttagttggagacagacgtccaccatctacgttcggccgggcgtacgtcgacggccatcgagcgtatttctttacgccgttggttcgcacgacgaaacgaaaccggaggggacgaccgtcccctagaagtacgtcggtagtctaggtgggtcgactactccgaagtacgttcgacgtaagggggttccgggtaccctacgttccggtagggtttacgaagggttcggacgtaggttcgaccgtaacgttcgggtacggggaacctaaggttaaccttaacctaccgttaccttaccgtaaccttaactaccgaacggtaccgaaccggtccgtacggaccgtaccggttcccgttaaggtaaacgtttacgttttttacggaaccttttaaatttttaacgtttaccgtttacggttaaacctaaacgtttaacgttttaaactttaaaccggtttaacccgtttaacccccgtttacgggttacgggttaacccgggtttcccgggaacccggggtaaccggggtaaccggtaaggggttaacgggtaacggtaacccggtaaacccggttaacggttcgggtacggtaccgttacggtaaccccg

SEQ ID NO: 215607 - DNA, 485 bp, Homo sapiens
  misc_feature: GYAE6OF02FWVJ9.1.34.D01.1.454.CMB.1.raw
  modified_base (392)..(392): a, c, t, g, unknown or other
  misc_feature (392)..(392): n is a, c, g, or t
  modified_base (483)..(483): a, c, t, g, unknown or other
  misc_feature (483)..(483): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttgctaatttattactgtcaanagtattatacgtaccctagtggacgttcggccgagggaccaaggtggaagtcacgacgtgtggctgcaccatctgtcctctactcttcccncc

SEQ ID NO: 215608 - DNA, 391 bp, Homo sapiens
  misc_feature: GYAE6OF02FQM5Z.1.34.D01.1.454.CMB.1.raw
  modified_base (385)..(391): a, c, t, g, unknown or other
  misc_feature (385)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgccatctgaacgcactcgtctgagcgggctggcaaggcgcatagnnnnnnn

SEQ ID NO: 215609 - DNA, 487 bp, Homo sapiens
  misc_feature: GYAE6OF02FSRES.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagtattatagtaccctagtcggacgttcggccgagggaccaaggtgaagtcaaccgactgtggctgac

SEQ ID NO: 215610 - DNA, 390 bp, Homo sapiens
  misc_feature: GYAE6OF02HUVAP.1.34.D01.1.454.CMB.1.raw
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgaactgtggctgcaccatctgtcttcatcttcccacctcctcacgcactcgtctgagcgggctggcaaggcgcatagnnnnnnn

SEQ ID NO: 215611 - DNA, 394 bp, Homo sapiens
  misc_feature: GYAE6OF02H5IZT.1.34.D01.1.454.CMB.1.raw
  modified_base (387)..(394): a, c, t, g, unknown or other
  misc_feature (387)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattatagtacccctacgtgacgttcggccaggggaccaaggtggaagtcaaccgaactgtggctgcaccatctgtcttcattcttcccgctatctgaacgcactcgtctgagcgggctggcaaggcgcatagnnnnnnnn

SEQ ID NO: 215612 - DNA, 488 bp, Homo sapiens
  misc_feature: GYAE6OF02I3C34.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtcaactagtatatagtaccctagtggacgttcggcagggacaaggtggaagtacgaaccgactggtcggctgacc

SEQ ID NO: 215613 - DNA, 512 bp, Homo sapiens
  misc_feature: GYAE6OF02HE3L6.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccgtaggttcagtggcagtgctatcgtgggacagtacttacactctcactatcagcacgcctgcacgctagaatatttgactaatttactactgtacaatagttattataaccgtaccctacgtggtacgttccggacgtacgggacgtaaggtcggaagtacgaaccggattggacgtcgtgaccg

SEQ ID NO: 215614 - DNA, 391 bp, Homo sapiens
  misc_feature: GYAE6OF02FHTDM.1.34.D01.1.454.CMB.1.raw
  modified_base (386)..(391): a, c, t, g, unknown or other
  misc_feature (386)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgccatctgaacgcactcgtctgacgcgggctggcaaggcgcatagnnnnnn

SEQ ID NO: 215615 - DNA, 389 bp, Homo sapiens
  misc_feature: GYAE6OF02FXZCN.1.34.D01.1.454.CMB.1.raw
  modified_base (375)..(375): a, c, t, g, unknown or other
  misc_feature (375)..(375): n is a, c, g, or t
  modified_base (381)..(389): a, c, t, g, unknown or other
  misc_feature (381)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcggccaggggaccaaggtggaagtcaaccgaactgtggctgcaccatctgtctcatctcccgcatctgaacgcactcgtctgagcgggctggcaagggcncatagnnnnnnnnn

SEQ ID NO: 215616 - DNA, 479 bp, Homo sapiens
  misc_feature: GYAE6OF02FSDU6.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagattttgctaatttattactgtcaactagtattatagtaccctagtgacgttcggccagggaccaggtgaagtcacgactgtggctgac

SEQ ID NO: 215617 - DNA, 496 bp, Homo sapiens
  misc_feature: GYAE6OF02I0YDK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaaatttattactgtcaacagttattatacgtaccctacgtggtacgttcggccagggaccaaggtcggaagtcgaaccgaacgttgcggtctgaccg

SEQ ID NO: 215618 - DNA, 490 bp, Homo sapiens
  misc_feature: GYAE6OF02HXDBK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagaaagagtcaccatcacttgccggcgagtcaggccatcagcgattctttagcctggttgcagcagaaaccagggcgagcccctcagatcgtagtctatggtgcatccagattgcaaggtggggtccatccaggttcagtggcagtgcatctgggacagattacactctcactatcagcagcctgcagcctgaagtatttgctaatttattactgtacaacagttattaatacgtaccctagtcggacgttcggccgagggaccaaggtgaagtcgaacgactgtggctgctacc

SEQ ID NO: 215619 - DNA, 510 bp, Homo sapiens
  misc_feature: GYAE6OF02H53N5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgttacaactagttaattacttaacgtacccctacgttcggacgtttcgggccgtaggggaccaaggtggaagtcgaaccggaacgtggtaggcgtgacc

SEQ ID NO: 215620 - DNA, 483 bp, Homo sapiens
  misc_feature: GYAE6OF02G9UG5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttattatacgtaccctagtgacgttcggccagggaccaaggtgaagtcaacgatgtggctgac

SEQ ID NO: 215621 - DNA, 530 bp, Homo sapiens
  misc_feature: GYAE6OF02JOP4E.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagatcaccatcacttgccgggcagtcaggccatcagcgattcttagcctggttgcagcagaaaccagggcgacgcccctcagactcgtagtctatggtgcatccagtattgacgaaggtcgggtacccagtccgaggttcgaggtggcagtgcatcgtgggacagtactttacgacttctactacgtatacagactacgcctagctagcctagaacgtacttttgacttaatttacttactagtacaactagttatatacgtacctaggtcgtacgttcggcgaaggtacgtaaggtagtaacgtacgaacgtacgtgtacggtctacgtac

SEQ ID NO: 215622 - DNA, 515 bp, Homo sapiens
  misc_feature: GYAE6OF02JEXM5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttaattatacgtaccccttagtggtaccggttcggccgtaggggaaccaagggtacggaagtaccgaaccggtaacttggtggccctagaccc

SEQ ID NO: 215623 - DNA, 394 bp, Homo sapiens
  misc_feature: GYAE6OF02IC7RK.1.34.D01.1.454.CMB.1.raw
  modified_base (318)..(318): a, c, t, g, unknown or other
  misc_feature (318)..(318): n is a, c, g, or t
  modified_base (389)..(394): a, c, t, g, unknown or other
  misc_feature (389)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtgggtcccatccaggttcagtggcagtgcatctgggacagattacactctcactatcagcagcctgcagcctgaagtattttgctaattttattactgtacaactagttattatacgtacccctagtggtacgttcggcaggggaccaaggtggaagtcaaccgactgngctgcacatctgtcttcatccttcccaccctcctcacgcactcgtctgagcgggctggcaaggcacatagnnnnnn

SEQ ID NO: 215624 - DNA, 541 bp, Homo sapiens
  misc_feature: GYAE6OF02G542N.1.34.D01.1.454.CMB.1.raw
  modified_base (281)..(281): a, c, t, g, unknown or other
  misc_feature (281)..(281): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctnagatcgtagtctatggtgcatccagattgcgaaggtcgggtcccatccgaggttcagtggcagtgcatcgtgggacagattacactctcatatcagcagcctgcagcctagaagtnttttgactaatttattactgtacaactagttattaactacgttaccccttaggtacggtaccggtttccggcccggtaaggggtaacccaagggttacggaaggttaccgaaccggtaaccgttgggtacggtcgtagtacccg

SEQ ID NO: 215625 - DNA, 484 bp, Homo sapiens
  misc_feature: GYAE6OF02I9DBV.1.34.D01.1.454.CMB.1.raw
  modified_base (172)..(172): a, c, t, g, unknown or other
  misc_feature (172)..(172): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggttgcagcagaaaccaggcgagcccctcagatcgtagtctatggtgcatccagattgcaaggtggggtccatccaggttcagtggcagtgcatctgggacagattacactctcactatcagcagccctgcagcctgaagtatttgctaatttattactgtacaaaagtattaatagtaccctagtggtacgttcgccgagggactaaggngaagtcaacgactgnggtctgcacanctgtcttcagtccttccgccta

SEQ ID NO: 215626 - DNA, 523 bp, Homo sapiens
  misc_feature: GYAE6OF02INNVA.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagcctggttgcagcagaaaccngggcgagcccctnagatcgtagtctagtggtgcatccagattgcaggtcggtcccatccaggttcagtgcagtgcatcgtgggacagattacactctcactatcagcagcctgacacggcctagaagtatttgacttaatttattactgtactaactagttatactaacgtaccctaggtcggtacgttcgggccgtaaggggacctaaagggtcggaaacgtccgaaaccggtaacgttggtacggtctagtacc

SEQ ID NO: 215627 - DNA, 395 bp, Homo sapiens
  misc_feature: GYAE6OF02JH0AP.1.34.D01.1.454.CMB.1.raw
  modified_base (373)..(373): a, c, t, g, unknown or other
  misc_feature (373)..(373): n is a, c, g, or t
  modified_base (378)..(395): a, c, t, g, unknown or other
  misc_feature (378)..(395): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgagattttgcaatttattactgtcaacagtattatagtacccctagtggacgttcggccagggggaccaaggtggaagtcaaccgaactgtggctgcacatctgtctcatcttccgcatctgaacgcactcctgagcgggctggcaaggcgnatagnnnnnnnnnnnnnnnnnn

SEQ ID NO: 215628 - DNA, 490 bp, Homo sapiens
  misc_feature: GYAE6OF02FRFU5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagtaattatacgtacccctagtggacgttcggccaggggaccaaggtggaagtcaaccgaatggtgctgcc

SEQ ID NO: 215629 - DNA, 637 bp, Homo sapiens
  misc_feature: GYAE6OF02I7Y9Z.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcactcgagtagtcgacggtaaggggtccggtacctacgtaccggttacggttacgtagggtcggacgtacggtcgacgtacgttcgggtacgggaacgtaggttaacttaacctaccgttcctactaacttactacgacgacgaccgtccgtcgacgaccgtaccgtaaggtaattttagtttcgaacttttaaatttacttacgttacgtaacctaagttagtttaattacgttaacccgttaaccgttacggtacggttacggttaccggaacgggtaacggaacggtaagggtaacgtacgtaacccgtaacgtacgttggacgtcgactaaccg

SEQ ID NO: 215630 - DNA, 209 bp, Homo sapiens
  misc_feature: GYAE6OF02H8S1M.1.34.D01.1.454.CMB.1.raw
  modified_base (168)..(209): a, c, t, g, unknown or other
  misc_feature (168)..(209): n is a, c, g, or t
tcagacgagtgcgtcacgaccggtgctcgatttagatcgtctgtgttgggtttggacgttcggccaggggaccaaggtggaagtcaaccgaactgtggctgcaccatctgtcttcatcttcccgccatctgaacgcactcgtctgagcgggctggcaaggcgcatagnnnnnnnnnnnnnnnnnnnnnnnnnnnnnnnnnnnnnnnnnn

SEQ ID NO: 215631 - DNA, 483 bp, Homo sapiens
  misc_feature: GYAE6OF02HX79T.1.34.D01.1.454.CMB.1.raw
  modified_base (230)..(230): a, c, t, g, unknown or other
  misc_feature (230)..(230): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaaccagggcgagcccctcagatcgtagtctatggtgcatccagattgcaaggtgggtcccatccgaggttcagtggcagtgcatctgggacagattacactctcactatcagcagcctgcagcctagtaagtatttgactaatttattactgtacaactagtatatacgtaccctagtcgtacgttcgacgagggaccaaggtggaatcgacgacgtgngctcgcacntctntcttnactctccnc

SEQ ID NO: 215632 - DNA, 485 bp, Homo sapiens
  misc_feature: GYAE6OF02GP7ZP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagttattatacgtaccctagtgtacgttcggcagggaccaaggtggaagtcaacgactgtggctgac

SEQ ID NO: 215633 - DNA, 491 bp, Homo sapiens
  misc_feature: GYAE6OF02H3WJP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagccactcagatcgtagtctatggtgcatccagattgcaaggtgggtccatccaggttcagtggcagtgcatctgggacagattacactctcactatcagcagcctgcagcctagaagtattttgactaatttattactgtacaatagtattatacgtaccctagtggtacgttcggaccaggggacctaaggtggaacgtacaaccgactgtgctacg

SEQ ID NO: 215634 - DNA, 501 bp, Homo sapiens
  misc_feature: GYAE6OF02I7DQT.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaaattttattactgtacaactagtaattatacgtaccctagtggtacgttcggccgaggggaccaaggtggaagtcgaaccgtaacgtggtcggctgacc

SEQ ID NO: 215635 - DNA, 393 bp, Homo sapiens
  misc_feature: GYAE6OF02GN4SS.1.34.D01.1.454.CMB.1.raw
  modified_base (383)..(393): a, c, t, g, unknown or other
  misc_feature (383)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttccgccctctcacgcactcgtctgagcgggctggcaaggcgcatagnnnnnnnnnnn

SEQ ID NO: 215636 - DNA, 512 bp, Homo sapiens
  misc_feature: GYAE6OF02IQGDA.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctagtggtgcatccagattgcgaaggtcgggtcccatccaggttcaggtggcagtgcagtcgtagggacagattacactctcactatcagcagcctgcagcctagaagtattttgacttaatttattactgtacaatagttaattatacgtacccttagtcggtacgttcggcgaaggggaccaaggtacggaagtacgaaccgtatggtacggctgacc

SEQ ID NO: 215637 - DNA, 494 bp, Homo sapiens
  misc_feature: GYAE6OF02HP3TV.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaatttattactgtacaactagttattatagtaccctagtggacgttcggcagggaccaaggtggaagtacgaaccgaactggtaggctgacc

SEQ ID NO: 215638 - DNA, 496 bp, Homo sapiens
  misc_feature: GYAE6OF02JE0YN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtcgggtcccagtccaggttcagtggcagtgcatctgggacagattacactctcactatcagcagcctgcagcctagaagtattttgacttaatttattactgtacaactagttaattataacgtaccccagtcgtacgttcggccgagggactaaggtcgaagtcaacgactgtcgctgacc

SEQ ID NO: 215639 - DNA, 392 bp, Homo sapiens
  misc_feature: GYAE6OF02GYO4K.1.34.D01.1.454.CMB.1.raw
  modified_base (384)..(392): a, c, t, g, unknown or other
  misc_feature (384)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtcaacagtattatagtacccctacgtggacgttcggccaggggaccaaggtggaagtcaaccgaactgtggctgcaccatctgtcttcatcttcccgcatctgaacgcactcgtctgagcgggctggcaaggcgcatagnnnnnnnnn

SEQ ID NO: 215640 - DNA, 390 bp, Homo sapiens; identical to SEQ ID NO: 215535
  misc_feature: GYAE6OF02FXK49.1.34.D01.1.454.CMB.1.raw
  modified_base (384)..(390): a, c, t, g, unknown or other
  misc_feature (384)..(390): n is a, c, g, or t

SEQ ID NO: 215641 - DNA, 418 bp, Homo sapiens
  misc_feature: GYAE6OF02F8JUP.1.34.D01.1.454.CMB.1.raw
  modified_base (378)..(378): a, c, t, g, unknown or other
  misc_feature (378)..(378): n is a, c, g, or t
  modified_base (395)..(418): a, c, t, g, unknown or other
  misc_feature (395)..(418): n is a, c, g, or t
tcagacgagtgcgtcacgaccggtgctcgatttagatcgtctgtgttgggtttgggagtcaggccatcagcgattctttagcctggttgctagcagaaaccaggcgagcccctcagatcgtagtctatggtgcatccagagttgcaaggtggggtccctatccaggttcagttggcagtgcatctggggacagattacactctcactagtcagcagcctgcgacgcctgaacgattttgctaattttattactgtcaacagttattatagttacccctagtgacgttcgcaggggaccaaggtgaagtcaaccgaacgtgtcggctgcaccatctagtcttcatcttcccgcctcctcacgcactcgtctgagcgggntgggcaaggcgcatagnnnnnnnnnnnnnnnnnnnnnnnn

SEQ ID NO: 215642 - DNA, 522 bp, Homo sapiens
  misc_feature: GYAE6OF02HHKIZ.1.34.D01.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgtattctttagccttggttgcagcaagaaaccagggcgacgcccctnagatcgtagtctagtggtgcatccagattgcgaagggtcgggtcccatccaggttcaggtggcagtgcatcgtgggacagtacttacactctacactancagcagcctgcacgcctagaagtnttttgacttaattttactactgtactaactagttacttataacgtaccctaggtacgtacgttccggcgtacgggacaaggtacgaagtaccaacggtactggtcggctgaccg

SEQ ID NO: 215643 - DNA, 389 bp, Homo sapiens
  misc_feature: GYAE6OF02G05FK.1.34.D01.1.454.CMB.1.raw
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (382)..(389): a, c, t, g, unknown or other
  misc_feature (382)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgactgtggctgcaccatctgtcttcatcttccgcatctgaacncactcgtctgagcgggctggcaaggcncatagnnnnnnnn

SEQ ID NO: 215644 - DNA, 506 bp, Homo sapiens
  misc_feature: GYAE6OF02HBPCB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtattttgactaatttattactgtacaactagttattatacgtaccctagtggtacgttcggccgtaggggacctaaggtcggaagtccgaaccgtaacgtggtacggctgacc

SEQ ID NO: 215645 - DNA, 511 bp, Homo sapiens
  misc_feature: GYAE6OF02HI15Y.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttaattatacgtaccctacgtcggtacgttccggccgtacggggacctaagggtacggaagtacgaaccggaactggtaggctagaccg

SEQ ID NO: 215646 - DNA, 505 bp, Homo sapiens
  misc_feature: GYAE6OF02JWGIC.1.34.D01.1.454.CMB.1.raw
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccagttcagtggcagtgcatcngggactagattacactctacactatcagcagcctgcagcctagaacgtnttttcgactaatttactactgtacaactgtaattactacgtaccctaagtggtaacttcggccgtaagggaccaaggtggaagtccaaacggactaggtcgtcgtgaccg

SEQ ID NO: 215647 - DNA, 486 bp, Homo sapiens
  misc_feature: GYAE6OF02G59HA.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccatctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttattatagtaccctagtggacgttcggccagggaccaaggtgaagtcaacgactgtggctgac

SEQ ID NO: 215648 - DNA, 385 bp, Homo sapiens
  misc_feature: GYAE6OF02I0QFT.1.34.D01.1.454.CMB.1.raw
  modified_base (375)..(375): a, c, t, g, unknown or other
  misc_feature (375)..(375): n is a, c, g, or t
  modified_base (381)..(385): a, c, t, g, unknown or other
  misc_feature (381)..(385): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagatttgcaatttattactgtcaacagtattatagtacccctagtggacgttcggccaggggaccaaggtggaagtcaaccgaactgtggctgcaccatctgtcttcatcttcccgcatctgaacgcactcgtctgagcggctggcaaggcncatagnnnnn

SEQ ID NO: 215649 - DNA, 503 bp, Homo sapiens
  misc_feature: GYAE6OF02HYNV8.1.34.D01.1.454.CMB.1.raw
  modified_base (254)..(254): a, c, t, g, unknown or other
  misc_feature (254)..(254): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttncagcagaaaccagggcagcccctcagatcgtagtctatggtgcatccagattgcaaggtgggtcccatccaggttcagtggcagtgcatctgggacagattacactctcactatcagcagcctgcagcctagaagtnttttgactaatttacttaactgtacaactagttacttaatacgttacccctagtaggaccgtttcgccgagggaccaagggtgaacgttacgaaccgattggtagctgaccg

SEQ ID NO: 215650 - DNA, 393 bp, Homo sapiens
  misc_feature: GYAE6OF02HV75L.1.34.D01.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (375)..(375): a, c, t, g, unknown or other
  misc_feature (375)..(375): n is a, c, g, or t
  modified_base (381)..(393): a, c, t, g, unknown or other
  misc_feature (381)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttnttactgtcaacngtattatagtacccctagtggacgttcggccaggggaccaaggtgaagtcaacgactgtgctgcacatctgtcttcatccttccaccttcctcacgtcactcgtctgacgcgggctggcaaggcncatagnnnnnnnnnnnnn

SEQ ID NO: 215651 - DNA, 544 bp, Homo sapiens
  misc_feature: GYAE6OF02JZ75P.1.34.D01.1.454.CMB.1.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttggggtttgggggagtcacgaccctgtcaggacacagctatggacatgagggtccccgctcagctcctggggctcctgctgctctggctcccaggtacctagctgtgactatccaattgacccagtctccgatcctcctgtctgcatcgtattggagacagagtcgaccatcacttgccgggcagtcaggccatcagcgattcttagcctggttgcagcagaaccngggcaggcccctnagactcgtagtctagtggtgcagtccgagtatttgcgtaaggtcgggtcccaatccgaggttcagtggcagtgcatcgtagggacagtacttacacttctcactatcagcagcctagcagctgaagtatttgacttaatttactactagtacaacgtagtattaacgtacgttaccctaggttcgtacgtttcgggacctacggggaactaagggtacggaacgtacgaaaccggtagttcggtacggtctaggtaccg

SEQ ID NO: 215652 - DNA, 542 bp, Homo sapiens
  misc_feature: GYAE6OF02ITK9M.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctcagatcgtagtctatggtgcatccagattgacgaagggtcgggtcccatccaggttcaggtggcagtgcagtcgtgggacagtacttacactctcactatcagcagcctgcagcctagtaagtattttgactaaattttacttactcgtactaactagttaattactacgtaccccttagtcggtaccgttcgggaccgtacggggaacctaaggtacggaacgttccgaaaccggtaacgtggtacggccgtagacccg

SEQ ID NO: 215653 - DNA, 474 bp, Homo sapiens
  misc_feature: GYAE6OF02I6I4U.1.34.D01.1.454.CMB.1.raw
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtatttgctaatttattactgtacaactagtattatacgtaccctagtcggacgttcggcagggacaggtgaagtcacgatggtgctgcacntctgtctcatcctccnc

SEQ ID NO: 215654 - DNA, 528 bp, Homo sapiens
  misc_feature: GYAE6OF02ISDE5.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtatttgactaatttattactgtacaactagtattactacgtaccctaggtcggacgttcggaccgaggggaaccgtaaggtacggaagtaccgaacgtaacgtggtggtcctacggcaacctaagtccgttagttccttacgaacttccgttacccgtacc

SEQ ID NO: 215655 - DNA, 504 bp, Homo sapiens
  misc_feature: GYAE6OF02HC9T2.1.34.D01.1.454.CMB.1.raw
  modified_base (254)..(254): a, c, t, g, unknown or other
  misc_feature (254)..(254): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttncagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactagtacaactagttattactaagttaccctagtacggtacgttcggccaggggaccaaggttaggaagtacgaaccgactcggtacggctgaccg

SEQ ID NO: 215656 - DNA, 480 bp, Homo sapiens
  misc_feature: GYAE6OF02HG774.1.34.D01.1.454.CMB.1.raw
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaatnttttgactaatttattactgtactaactagttatatagtaccctagtgacgttcggcagggacaaggtgaagtcaacgactggtgctgc

SEQ ID NO: 215657 - DNA, 392 bp, Homo sapiens
  misc_feature: GYAE6OF02HO681.1.34.D01.1.454.CMB.1.raw
  modified_base (383)..(392): a, c, t, g, unknown or other
  misc_feature (383)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgagcgggctggcaaggcgcatagnnnnnnnnnn

SEQ ID NO: 215658 - DNA, 499 bp, Homo sapiens
  misc_feature: GYAE6OF02FN4YO.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttattatacgtaccctagtcggtacgttcggccgagggaccaaggtggaagtacgaaccgacgtgtcggtctgtaccg

SEQ ID NO: 215659 - DNA, 535 bp, Homo sapiens
  misc_feature: GYAE6OF02JI98X.1.34.D01.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctatggctcccaggtaccagctgtgacatccaattgacccagtctccatcctcctgtctgcatctattggagacagagtcaccatcacttgccgggnagtcaggccatcagcgattcttagcctggttgcagcagaaaccagggcgagcccctcagatcgtagtctatggtgcatccagattgcaaggtcgggtcccatccaggttcagtggcagtgcagtcgtagggacaggattacacgtctacactatcagtccagcctgacagtcctagtaactattttagactaaattttatactgtactaactagttaacttataacgtacccttaggtcgtaacgttccggaccgtagggtaccgaacggtggaaacgtccgtaaaccggacgttaggtcggtactagtacccg

SEQ ID NO: 215660 - DNA, 579 bp, Homo sapiens
  misc_feature: GYAE6OF02HL1MP.1.34.D01.1.454.CMB.1.raw
  modified_base (98)..(98): a, c, t, g, unknown or other
  misc_feature (98)..(98): n is a, c, g, or t
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (439)..(439): a, c, t, g, unknown or other
  misc_feature (439)..(439): n is a, c, g, or t
tcagacgagtgcgtcacgaccggtgctcgatttagatcgtctgtgttgggtttggggagtcagaccctgtcaggacacagcatggacatgaggtcccntcagctcctgggctcctgctgctctggctcccaggtaccagctgtgacatccaattgacccagtctccatcctcctgtctgcatctattgganacagatcacatcacttgccggnagtcaggccatcagcgtattcttagcctggttcnctagcaagaaccgngggcacgccctagagacttcgtagtctagtggtcactagtccagtacttgcgtaaggtcggtacccagtccgtaggttcaggttcgactaggtcgactagttcgtagggactagtacgttacactcgtacacgtatcgacgtcgtagtcctaggtacctacgtccgttagaacggttnttttacggacttaagtttactacgtacgtactaaacgtgtttaacgttacgtaccggttaccttacggtacgtacgttccggaacgtacgggtaacctaggtacgtacgtcgtaaccgtagttcggtacgcgttgtaccg

SEQ ID NO: 215661 - DNA, 492 bp, Homo sapiens
  misc_feature: GYAE6OF02GK64X.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtggcagtgcatctgggacagattacactctcactatcagcagcctgcagcctgaagtattttgctaatttattactgttacaactagttaattatacgtaccctagtggacgttcggccgagggaccaagggtagaagtcaaccgaactgtggctgacc

SEQ ID NO: 215662 - DNA, 525 bp, Homo sapiens
  misc_feature: GYAE6OF02FL02G.1.34.D01.1.454.CMB.1.raw
  modified_base (520)..(525): a, c, t, g, unknown or other
  misc_feature (520)..(525): n is a, c, g, or t
tcagacgagtgcgtcacgaccggtgctcgatttagatcgtctgtgttgggtttgggggaggcttgataaagcctggggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccggttcaccatctcccgagacaattcgcagaacacgttgtttttgcaaatggacagcctgagagtcgcggacacggccgtctattattgtgcgacgcgctattataatataggctactggggccagggaaccctggtcaccgtctcctcagcctccaccaagggcccatcggtcttcccctggcgccctgctccaggacgcaccctccgagacgcacacgccggccctgggctgcctggtcaaggactacttccacgcactcgtctgacgcgggctggcaaggcgcatgnnnnnn

SEQ ID NO: 215663 - DNA, 491 bp, Homo sapiens
  misc_feature: GYAE6OF02IP2YP.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtntttgactaattttattactgtcaactagttaattatacgtaccctagtgacgttggccgagggaccaaggtggaagtcgaaccgtatggtcgctgacc

SEQ ID NO: 215664 - DNA, 488 bp, Homo sapiens
  misc_feature: GYAE6OF02F1RUU.1.34.D01.1.454.CMB.1.raw
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagnttttgctaatttatactgtacaactagtattatagtaccctagtgacgttcggccgagggaccaaggtgaagtcaaccgaactggtcggtctgacc

SEQ ID NO: 215665 - DNA, 492 bp, Homo sapiens
  misc_feature: GYAE6OF02GXV1D.1.34.D01.1.454.CMB.1.raw
  modified_base (281)..(281): a, c, t, g, unknown or other
  misc_feature (281)..(281): n is a, c, g, or t
  modified_base (485)..(485): a, c, t, g, unknown or other
  misc_feature (485)..(485): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctgaagtatttgctaatttatactgtacaactagttattataagtacccctagttcggacgttcggccgagggaccaaggtgaagtcgaaccgataggngctgacc

SEQ ID NO: 215666 - DNA, 519 bp, Homo sapiens
  misc_feature: GYAE6OF02GIWDT.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctagaagtattttgactaatttattactgtactaactagttaattatacgttaccccgtagtcggtacgttccgggccgtaacggggtaccaagggtacggaacgtacgaaccggaacgttggtacggtctgacc

SEQ ID NO: 215667 - DNA, 505 bp, Homo sapiens
  misc_feature: GYAE6OF02HRIS4.1.34.D01.1.454.CMB.1.raw
tcagacgagtgcgtcacgaccggtgctcgatttagatcgtctgtgttgggtttgggggagtcagaccctgtcaggacacagcatggacatgagggcccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctcagatcgtagtctatggtgcatccagattgcaaggtgggtcccatccaggttcagtggcagtgcatctgggacagattacactctcactatcagcagcctgcagcctgaagtattttgactaatttatactgtacaactagttacttatacgttacccctaggtcggacgtttcggccgaaggggaccaagggtaggaagtcgaaccgtatggtacggtctgacc

SEQ ID NO: 215668 - DNA, 394 bp, Homo sapiens
  misc_feature: GYAE6OF02JF29V.1.34.D01.1.454.CMB.1.raw
  modified_base (387)..(394): a, c, t, g, unknown or other
  misc_feature (387)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtacaacagtattatagtacccctagtggacgttcgccaggggaccaaggtggaagtcaaccgaactgtggctgcaccatctgtctcatccttcccgcatctagaacgcactcgtctgacgcgggctggacaaggcgcatagnnnnnnnn

SEQ ID NO: 215669 - DNA, 387 bp, Homo sapiens
  misc_feature: GYAE6OF02HZRQM.1.34.D01.1.454.CMB.1.raw
  modified_base (375)..(375): a, c, t, g, unknown or other
  misc_feature (375)..(375): n is a, c, g, or t
  modified_base (381)..(387): a, c, t, g, unknown or other
  misc_feature (381)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtatatagtacccctagtggacgttcggccaggggaccaaggtggaagtcaaccgaactgtggctgcaccatctgtcttcatcttcccacctcctcacgcactcgtctgagcgggctggcaaggcncatagnnnnnnn

SEQ ID NO: 215670 - DNA, 564 bp, Homo sapiens
  misc_feature: GYAE6OF02FYGRN.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctatggtgcatccagattgcaaggtgggtcccatccaggttcagtggcagtgcatcgtgggacagattacactctcactatcagcagcctgcacgcctagaagtattttacgacttaatttacttactgttaccaactagttaattaactaacgttaccccgttacggttacgggtaccggtttaccgggacccggtaagggggtaaccctaaaggggttacggtaaacgttaccgaaacccggtaacgttgggtacggtaccgtagtacccg

SEQ ID NO: 215671 - DNA, 512 bp, Homo sapiens
  misc_feature: GYAE6OF02JWDCZ.1.34.D01.1.454.CMB.1.raw
  modified_base (384)..(384): a, c, t, g, unknown or other
  misc_feature (384)..(384): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcaagaaaccagggcgacgcccctcagatcgtagtctatggtgcatccagtattgacgaagggtcgggtcccagtccaggttcaggtggcagtgcatcgtagggacagattacactctcacttancagcagcctgcagcctagaagtntttgattaatttatactgtacaatatattacacgttaccctagtcggtacgttcggccgagggtaccgaaggtagaacgtacgaacgacgtggtacggctacgac

SEQ ID NO: 215672 - DNA, 500 bp, Homo sapiens
  misc_feature: GYAE6OF02H53NN.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtgcagtgcatctgggacagattacactctcactatcagcagcctgcagcctagaagtatttgacttaaatttattactgtactaactagttattatacgttacccctagtcggtacgtttggaccgtaggggaccaaggtgaagtcaaccggactggtgctgacc

SEQ ID NO: 215673 - DNA, 480 bp, Homo sapiens
  misc_feature: GYAE6OF02JHA7M.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaattattactgtcaacagttattatagtaccctagtgtacgtcggcagggacaaggtgaagtcaaccgactgtggctgcc

SEQ ID NO: 215674 - DNA, 516 bp, Homo sapiens
  misc_feature: GYAE6OF02GM07R.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtattttggctaaattttacttactgtacaacgtagttaattataacgttaccctacgtagtacgttcggaccgtaggggacccaaggtacggaagtacgaaccggaacgtgtaggtctgaccg

SEQ ID NO: 215675 - DNA, 386 bp, Homo sapiens
  misc_feature: GYAE6OF02GWG9H.1.34.D01.1.454.CMB.1.raw
  modified_base (380)..(386): a, c, t, g, unknown or other
  misc_feature (380)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttccacctctcacgcactcgtctgagcggctggcaaggcgcatagnnnnnnn

SEQ ID NO: 215676 - DNA, 528 bp, Homo sapiens
  misc_feature: GYAE6OF02GZXG0.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctagaagtattttgactaaatttattactgtactaactagttaattataacgtaccccgtagtacggtacgttcgggaccgtaacggggaacccgtaaggtacggaacgttaccaaaccggtaacttaggtacggacgtagacc

SEQ ID NO: 215677 - DNA, 484 bp, Homo sapiens
  misc_feature: GYAE6OF02GNZFM.1.34.D01.1.454.CMB.1.raw
  modified_base (391)..(391): a, c, t, g, unknown or other
  misc_feature (391)..(391): n is a, c, g, or t
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgctaatttattactgtacaactagttattatacgtaccctagtggtacgttcggccagggaccaaggtgaagtcaacgatgnggctgac

SEQ ID NO: 215678 - DNA, 400 bp, Homo sapiens
  misc_feature: GYAE6OF02GNIO7.1.34.D01.1.454.CMB.1.raw
  modified_base (377)..(377): a, c, t, g, unknown or other
  misc_feature (377)..(377): n is a, c, g, or t
  modified_base (381)..(400): a, c, t, g, unknown or other
  misc_feature (381)..(400): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagtattgcaaggtgggtcccatccaggttcagtggcagtgcatctgggacaggattacactctcactatcagcagcctgcagcctgaagattttgcaattttatactgtcaacagtattatagtacccctacgtggacgttcggccaaggggaccaaggtggaagtcaaccgaatgtggctgcaccatctgtctcatcttcccacctctcacgcactcgtctgacgcggctggcaagccnatgnnnnnnnnnnnnnnnnnnnn

SEQ ID NO: 215679 - DNA, 491 bp, Homo sapiens
  misc_feature: GYAE6OF02IB1QF.1.34.D01.1.454.CMB.1.raw
  modified_base (467)..(491): a, c, t, g, unknown or other
  misc_feature (467)..(491): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgagattttgcaattttattactgtcaacagtactattagtacccgttacccgtacggtacggttacggtcgaccgggaacgggaacggtagggtaaggtactaaccgaaaccgtagtggtcgtcgtcgaccactactcgttcgttcttactactttcccgtcccgtactacttcgaacgtaccgacctacgttccgtcgtaggacggggccgtggtcggaaacggtacgggccactaaggtgcagnnnnnnnnnnnnnnnnnnnnnnnnn

SEQ ID NO: 215680 - DNA, 501 bp, Homo sapiens
  misc_feature: GYAE6OF02GMOLM.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagactcgtagtctatggtgcatccagattgcaaggtgggtcccagtccaggttcagtggcagtgcatcgtgggacagattacactctcactatcagcacgcctgcacgcctgaagtattttgactaatttattactgtacaactagttattactacgtaccctagtcggacgttcggcgagggacctaaggtcggaagtacaccgtagtggtggctgacc

SEQ ID NO: 215681 - DNA, 645 bp, Homo sapiens
  misc_feature: GYAE6OF02IBIBD.1.34.D01.1.454.CMB.1.raw
  modified_base (286)..(286): a, c, t, g, unknown or other
  misc_feature (286)..(286): n is a, c, g, or t
  modified_base (367)..(367): a, c, t, g, unknown or other
  misc_feature (367)..(367): n is a, c, g, or t
tcagacgagtgcgtcacgaccggtgctcgatttagatcgtctgtgttgggtttgggggaggtcaggaccctaggtcaggacacgagcatggacatgagggtccccgctcagctcctggggctcctgctgctctggctcccaggtaccagctgtgacatccaattgacccagtctccatcctcctgtctgcatctattggagacagagtcaccatcacttggccgggcgagtcaggccatcagcgattcttagcctggttgcagcaagaaccagggccgagcccctnagatcgtagtctatggtgcatccagtacttgcgtaaggggtcgggtccccaagtcccgaggttcaaggttcggactaggtnactagttccgtaggggaccaagtacttacaccttctacaacttatcgacgaccacgtcctcggacacggtacctaggtaaacgttattttacggactttaaacttttaactttactacgttaacaacgttaagtttaactttaacgtaaccgttaaccccgttaggttacgggtaaccggttttccgggacccggtaacgggggtaacccgtaaacggggttacggtaacggttaacccgaaaccggtaacgttcgggtcgggtaccctggtaacccg

SEQ ID NO: 215682 - DNA, 515 bp, Homo sapiens
  misc_feature: GYAE6OF02GK18H.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccagtccaggttcagtggcagtgcatcgtgggacagattacacttctcactatcagcagcctgcagcctgaagtattttgacttaatttattactagtacaactagttattaatacgttaaccctagtacggtacgttcggccgtaggggacctaagggtggaagtacgaaccgtaacgtggtcggactgtaccg

SEQ ID NO: 215683 - DNA, 495 bp, Homo sapiens
  misc_feature: GYAE6OF02HA636.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaatagtattatacgtaccctagtggtacgttcggccgagggaccaagggtggaacgtcgaaccggactggtggactgacc

SEQ ID NO: 215684 - DNA, 542 bp, Homo sapiens
  misc_feature: GYAE6OF02G0G55.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaacgagggcgacgcccctnagatcgtagtctagtggtgcatccagtattgcgaagggtcgggtcccatccgaggttcaggtggcagtcgcagtcgtagggacagtacttacacttctcactatcagcacgcctgcagcctagaagtattttgacttaatttatactagtactaatagttaattacgtaaccgttaccctaggtacggtacgttccgggaccggaagggtaaccgtaagggtacgaacgtaccgaaccggtactgggtcgtcgtacgaccg

SEQ ID NO: 215685 - DNA, 658 bp, Homo sapiens
  misc_feature: GYAE6OF02GSGPJ.1.34.D01.1.454.CMB.1.raw
  modified_base (305)..(305): a, c, t, g, unknown or other
  misc_feature (305)..(305): n is a, c, g, or t
tcagacgagtgcgtcacgaccggtgctcgatttagatcgtctgtgttggggtttgggggagtcacgaccctgttcaggtacacagacatgggacactgagggtccccgctcacgcgtcctggggctacctgctgcgtctggctcccaggtaccaggctgtgacatccaattgacccagtcctccatccctccctcgtctcgcgatctacgttcggacgacagacgtcaccagtccacttcggaccgggcgacgtcaggccatacaggcgtattactttagcctaggtttgcctagcaagaaaccngggcgacgcccctcacgactcggtagtcctagtggtgtctagttcccaggtacgtttcggaccgtaacgggggttccgggtacccagtcccgtaggttcgaggtggactaggtcgctagtcgtaggggaactagtacttacactactacaacgttagtcgagcagccgtgtcgtaggtccttagagtactttggacttaattttacgtactacgttactaacttagttaactttacgaaccgttaccccgtaggtacgggtaaccgtttccgggaaccgtaacggggtaacctaaaggggttacggaacggttaccgaaaccggttacgtcgggtacggtaccgtgtaacccg

SEQ ID NO: 215686 - DNA, 489 bp, Homo sapiens
  misc_feature: GYAE6OF02HFI0K.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttgactaatttattactgtacaactagtattatacgtaccctacgtggacgttcggacgaggggaccaaggtgaagtcaaccgaactggtggctgcacatctgtcttcactcctcccgc

SEQ ID NO: 215687 - DNA, 491 bp, Homo sapiens
  misc_feature: GYAE6OF02GNEC2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtcgggtcccatccaggttcagtggcagtgcatcgtgggacagattacactctcactatcagcagcctgcagcctagaagtattttgacttaatttattactgtacaactagtattatacgtaccctagtcggacgttcggccgagggaccaaggtgaagtcaacgatgtcggctgac

SEQ ID NO: 215688 - DNA, 491 bp, Homo sapiens
  misc_feature: GYAE6OF02GW5RV.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttattatacgtaccctagtggacgttcggccagggaccaaggtgaagtcaacgtactgtcggctgacc

SEQ ID NO: 215689 - DNA, 590 bp, Homo sapiens
  misc_feature: GYAE6OF02ITLFV.1.34.D01.1.454.CMB.1.raw
  modified_base (268)..(268): a, c, t, g, unknown or other
  misc_feature (268)..(268): n is a, c, g, or t
  modified_base (432)..(432): a, c, t, g, unknown or other
  misc_feature (432)..(432): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctcgagactcgtagtctagtggtagctactccagtattgacgtagggtcggtaccctatccgtaggtacaggtcggacagtcgactagtcgtagggacagtacttacgactctactactatacacgacacgtcctgacacgccttagaaagttntttcgacttaaattttacgttactgtaactaacgtagtttaacttagtaaccgttacccgtaggttaccgtacggttccgggaaccgtaacggggtactaagggtacgtaacggtaaccgtaacccggtaacgtgggtacggtaccgtacgtaacccg

SEQ ID NO: 215690 - DNA, 385 bp, Homo sapiens
  misc_feature: GYAE6OF02GNYSS.1.34.D01.1.454.CMB.1.raw
  modified_base (379)..(385): a, c, t, g, unknown or other
  misc_feature (379)..(385): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgaactgtggctgcaccatctgtctcatcttccacctctcacgcactcgtctgagcgggctggcaaggcgcatagnnnnnnn

SEQ ID NO: 215691 - DNA, 522 bp, Homo sapiens
  misc_feature: GYAE6OF02GCAD8.1.34.D01.1.454.CMB.1.raw
  modified_base (280)..(280): a, c, t, g, unknown or other
  misc_feature (280)..(280): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtcgggtcccatccaggttcaggtggcagtgcatcgtgggacagattacactctcactatcagcagcctgcagcctagaagtnttttgacttaaatttattactagtactaactagttaattaatacgttaccctagtggtaccgttcgggaccgaggggacctaagggtaggtaacgtaccgaaccggtaacgtggtcggtactgacc

SEQ ID NO: 215692 - DNA, 504 bp, Homo sapiens
  misc_feature: GYAE6OF02HKS2O.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaatatttgactaatttattactgtacaactagttattatacgtaccctagtcgtacgttcggaccgaggggacctaagggtcggaagtccgaaccggacgtcggtaggctgaccg

SEQ ID NO: 215693 - DNA, 500 bp, Homo sapiens
  misc_feature: GYAE6OF02HP5Y5.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtccatccaggttcagtggcagtgcatctgggacagattacactctcactatcagcagcctgcagcctagaagtattttgctaatttatactgtacaactagttaattatagttacccctagttacggtacgttcggcctaggggacctaagggtcgaagtcaacggaactggtaggctgtac

SEQ ID NO: 215694 - DNA, 390 bp, Homo sapiens
  misc_feature: GYAE6OF02IT3N3.1.34.D01.1.454.CMB.1.raw
  modified_base (378)..(378): a, c, t, g, unknown or other
  misc_feature (378)..(378): n is a, c, g, or t
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgacgcgggctggcaaggcncatagnnnnnnn

SEQ ID NO: 215695 - DNA, 560 bp, Homo sapiens
  misc_feature: GYAE6OF02G55YL.1.34.D01.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctccaggtaccagctgtgacatccaattgacccagtctccatcctccctgtctgcatctattgganacagngtcaccatcacttgccgggcgagtcaggccatcagcgattcttagcctggttgcagcaagaaaccngggcgacgcccctcagactcgtagtctagtggtncatccagtattgacaaggtcgggtacccagtccgaggttcaggtggcagtgcagtcgtgggactagtatacactctcactatcagcagctagctagcctagaacgtnttttcgacttaagtttacttacgtgtacgtaactagttaacttaacgtaccgttaacccttaggttcggtaaccggtttcggaccgtaacggggtacctaaggggtacggtaacgtaccgtaaccggtacgttggtacggtcgtacggtaccg

SEQ ID NO: 215696 - DNA, 521 bp, Homo sapiens
  misc_feature: GYAE6OF02HQX6K.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttgccgggcagtcaggccatcagcgattctttagcctggttgcagcagaaaccagggcgagcccctcagatcgtagtctatggtgcatccagattgcaaggtcgggtcccatccaggttcagtggcagtgcatcgtgggacagattacactctcactatcagcagcctgcagcctgaagtntttgactaatttattactgtactaatattaattatacgttacccctagttcggtaccggttcggaccgaacggggacctaaagggtacggaagtaccaacccggaacttggtacggccgtagtacccg

SEQ ID NO: 215697 - DNA, 492 bp, Homo sapiens
  misc_feature: GYAE6OF02HOL5Z.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaatttattactgtacaactagtattatacgtaccctagtcgacgttcggcgagggacctaaggtggaagtcaaccgactggtcggctgac

SEQ ID NO: 215698 - DNA, 520 bp, Homo sapiens
  misc_feature: GYAE6OF02H6815.1.34.D01.1.454.CMB.1.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcaagaaaccagggcgagcccctnagatcgtagtctatggtgcatccagtattggcaagggtcgggtacccatccaggttcaggtggcagtgcagtcgtgggacagtattacactctcaactatcagcacgcctgcagccctagaacgtnttttagacttaattttacgttactgtacaatagttattatacgttaccctagtgtacgttcggacgaggggaccaagggtggaacgtccgaacggactaggtggtctagcc

SEQ ID NO: 215699 - DNA, 483 bp, Homo sapiens
  misc_feature: GYAE6OF02ITL9U.1.34.D01.1.454.CMB.1.raw
  modified_base (280)..(280): a, c, t, g, unknown or other
  misc_feature (280)..(280): n is a, c, g, or t
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctgaagtattttgactaatttattactgtacaanagttatataacgtaccctagtgacgttcggcagggaccaaggtgaagtcaacgactgtgctgacc

SEQ ID NO: 215700 - DNA, 489 bp, Homo sapiens
  misc_feature: GYAE6OF02GE48Z.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtacaactagtaattatagtaccctagtggacgttcggccgtagggaccaaggtgaagtcgaaccgtatgtggctgacc

SEQ ID NO: 215701 - DNA, 575 bp, Homo sapiens
  misc_feature: GYAE6OF02IILOF.1.34.D01.1.454.CMB.1.raw
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtggtttggggtttgggcatggacgatgagggtccccgcgtcagctcctgggggtctccttgctgctctggctcccaggtaccagctgtgacatccaattgacccagtctccattcctcctgtctgtacatctattggagacagagtcaccatcgacgttggcccggggagtagttcgaagggccaggtccagccgtagtttcctttagccttggttncagcagaaaccngggctagcccctanagatcgtagtctatggtgcactccgagtattggacgaagggtcgggtacccagtccgaggttcagtggcagtgcatcgtggacagtattacactctcactatcgagcagcctgacagcctagaagtatttgacttaatttattactgtacaactagtatatacgtaaccctagacgtacgttcggacgtaaggggtacctaaggtcgaacgtaccgaaccgtaagttcggtaaggtctagacctaaccgtagttcgtcgttcttacgacttcccgttacccgtaacccg

SEQ ID NO: 215702 - DNA, 465 bp, Homo sapiens
  misc_feature: GYAE6OF02JS4GT.1.34.D01.1.454.CMB.1.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (424)..(425): a, c, t, g, unknown or other
  misc_feature (424)..(425): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (432)..(433): a, c, t, g, unknown or other
  misc_feature (432)..(433): n is a, c, g, or t
  modified_base (435)..(465): a, c, t, g, unknown or other
  misc_feature (435)..(465): n is a, c, g, or t
tcagacgagtgcgtcacgaccggtgctcgatttagatcgtctgtgttgggtttgggagtcaggccatcagcgattctttagcctggttgctagcagaaaccagggcgagcccctcagatcgtagtctactggtgcatccgagattgcaagggttggggtcccatccaggtttcagtggcagtgcatctgggacaggattacactcgtcacgtatcagcagcctgacacgcctagaacgtattttcgcaattttattactgtcaacagttattatagtacccctagtggacgttcggccaggggaccaaggtggaagtcaacccgaacgtggtcggcttgctaccgatctagtaccttacattccttacccaacctacctcacgcactcgtctgacgcggctggcaaggccgnaatagnagcnannancancnnannnnnnnnnnnnnnnnnnnnnnnnnnnnnnn

SEQ ID NO: 215703 - DNA, 516 bp, Homo sapiens
  misc_feature: GYAE6OF02G5LTQ.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggtgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtatttgactaatttattactgtacaactagtattatacgtacccctagtcggtacgttcggccgaggggaccaagggtacgaagtaccaaccgtacgtcggtggtacgtcgacgacctattctcgttacttcgacttcccgttccccgtacc

SEQ ID NO: 215704 - DNA, 487 bp, Homo sapiens
  misc_feature: GYAE6OF02F472G.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgagtctatggtgcatccagattgcaaggtgggtcccatccaggttcagtggcagtgcatcgtgggacagattacactctcactatcagcagcctgcagcctgaatattttgactaatttattactgtcaatagttattactacgtaccctagtcgacgttcggccgagggaccaaggtgaagtacaacgactggcggctgcc

SEQ ID NO: 215705 - DNA, 531 bp, Homo sapiens
  misc_feature: GYAE6OF02G8OT0.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgatttcttagcctggttgcagcagaaaccagggcgagcccctcagatcgtagtctatggtgcatccagattgcaaggtggggtcccatccaggttcagtggcagtgcatctggggacagattacgactctcactatcagcagcctgcacgctgaacgtattttgactaatttacttacgtcgtacaaactagtaattaactagtaaccccctagtcggtacgttcgggaccgaagggggtaaccaaagggtcggaaacgtaccgtaaaccgaagtcgtggctacgctaaccagtctgtcgttcacttatcccccgtccc

SEQ ID NO: 215706 - DNA, 490 bp, Homo sapiens
  misc_feature: GYAE6OF02FN01W.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtattttgactaatttattactgtacaactagtattatacgtacccctagtgacgttcggcaggggaccaaggtgaagtcaaccgaactgtggctgacc

SEQ ID NO: 215707 - DNA, 531 bp, Homo sapiens
  misc_feature: GYAE6OF02IPR8H.1.34.D01.1.454.CMB.1.raw
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgcatctgggacagattacactcncactatcagcagcctagcagcctagaagtnttttgactaaatttagttactgtaccaaactagttaacttaatacgtaccctacgtacgggtacgtttccggaccgagggtaccgtaagggttaggaacgtacgaaccggtaacgttaggtacggtcgtacgtaccg

SEQ ID NO: 215708 - DNA, 632 bp, Homo sapiens
  misc_feature: GYAE6OF02INVH3.1.34.D01.1.454.CMB.1.raw
  modified_base (237)..(237): a, c, t, g, unknown or other
  misc_feature (237)..(237): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
tcagacgagtgcgtcacgaccggtgctcgatttagatcgtctgtgttggggtttggggagtcctagacccttggtcaggactacagcatggacatggagggtccccgctccagctcctggggctccgtgcttgctcgtggctcccaggtaccagctagtgacatccaattcgacccagtcttccgatcctcctgtcgtgctatctattggagacagagtcaccatcacttgccgggngagtcagggcatcgagcgattcgttagcctggttgcagcagaaccnggcgacgcccctnagtactcgtagtctagtggtncatccagacttgcgtaaggtcggaccatccgaggttcaggtggcgagtgcatcgtggactagtacttacacttcgtactaacttactacagtcgacgtccgttaggacacggcccttaggtaactagttttacgacttaagttttaacttacgtacgttaacctaaacgttaagtttaactttaacgttaccgttaaccccttagggttacggtaaccggtttaccgggacccgttaaacgggggtaccctaaagggttcggtaaacgttcccgaaacccggtaacgttcgggtacggtaccgtaggttaacccg

SEQ ID NO: 215709 - DNA, 563 bp, Homo sapiens
  misc_feature: GYAE6OF02HP80C.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagactcgtagtctatggtgcatccagattgacaagggtcgggtcccagtccgaggttcaggtgcagtgcatcgtagggacagtattacactctcactatcagcagcctgcagcctagaagtatttgacttaatttattactgtactaactagttaattactaacgtacccttacggtcgggtaaccgtttccgggaccgtaacgggggtaaccctaaagggggtacggtaaacgttaccgaaacccggtaacgttacgggtcggtaccgttacgtaacccg

SEQ ID NO: 215710 - DNA, 498 bp, Homo sapiens
  misc_feature: GYAE6OF02HNWES.1.34.D01.1.454.CMB.1.raw
  modified_base (371)..(371): a, c, t, g, unknown or other
  misc_feature (371)..(371): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactancagcagcctgcagcctgaagtattttgctaatttattactagtcaactagtattatacgtaccctagtcggtacgttcggccgtagggacctaaggtcggaagtccgaacggactggtggctgaccg

SEQ ID NO: 215711 - DNA, 499 bp, Homo sapiens
  misc_feature: GYAE6OF02HLCHH.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctagtggtgcatccagattgcaaggtgggtcccatccaggttcagtggcagtgcatcgtgggacaggtattacactctcactatcagcagcctgcagcctagaagtattttgactaatttattactgtacaactagttattataacgtaccctagtcggtacgttcggccgagggaccaaggtcggaagtcaaccgatggtgctgacc

SEQ ID NO: 215712 - DNA, 490 bp, Homo sapiens
  misc_feature: GYAE6OF02GLDQ0.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttgctaatttattactgtacaactagtattatacgtaccctagtcgtacgttcggccaggggaccaaggtgaagtcacgactgtggctgtacctatctgtcttcatccttcccacctccc

SEQ ID NO: 215713 - DNA, 387 bp, Homo sapiens
  misc_feature: GYAE6OF02FZTPV.1.34.D01.1.454.CMB.1.raw
  modified_base (381)..(387): a, c, t, g, unknown or other
  misc_feature (381)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatctccgccatctgaacgcactcgtctgagcggctggcaaggcgcatagnnnnnnn

SEQ ID NO: 215714 - DNA, 594 bp, Homo sapiens
  misc_feature: GYAE6OF02F7995.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctcagatcgtagtctagtggtgcatccagtattgcgaagggtcggggtacccagtccgaggttcaaggttggcaggtgctagtcgtgggacagattacactctcactatcagcagcctgcagcctagaagttattttcgacttaatttacttacttgtactaaacgtagtttaacttagttaaccgtaaccccgttaggttaccgggtaacggtttcccgggaaccggtaacgggggtaacccgtaaaggggttacgggtaaacggttacccgaaaccgggtaaccgttcgggtacgggtaccgtggtaaccccg

SEQ ID NO: 215715 - DNA, 493 bp, Homo sapiens
  misc_feature: GYAE6OF02G6S4T.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaaatttattactgtacaactagttattatacgtaccctagtggacgttcggccgagggaccaaggtggaagtcaaccggtatgtaggctgac

SEQ ID NO: 215716 - DNA, 480 bp, Homo sapiens
  misc_feature: GYAE6OF02F329J.1.34.D01.1.454.CMB.1.raw
  modified_base (391)..(391): a, c, t, g, unknown or other
  misc_feature (391)..(391): n is a, c, g, or t
  modified_base (472)..(472): a, c, t, g, unknown or other
  misc_feature (472)..(472): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgctaatttatactgtcaactagtattatagtaccctagtgacgttcggccgagggacaaggtgaagtcaacgactgnggctgacc

SEQ ID NO: 215717 - DNA, 845 bp, Homo sapiens
  misc_feature: GYAE6OF02J3K8Q.1.34.D01.1.454.CMB.1.raw
tcagacgagtgcgtcacgaccggtgctcgatttagatcgtctgtgttgggtttgggggtaggtcgagaccctgtcaggacacagcatggacatgagggtccccgctccagctcctggggctccgtgctgctctggctcccaggtaccagctgtgacatccaattcgacccagtcctccactccctccctgtacctcgctatcttaattggaagtaccaggactccaacctactcctaccgtttcggacccggggcgtacggtaccacgggtcccaacgttccaggaccgtagtttaccgtttaacgtcccgttgggttcgtaccgacggtacccgaacggaaacccggacggggaccgaaccggtcccccctagtaacggacgttaccggttaggttaccgtacggtacggggtctacctaacgttccgaacggtacgtttaggaacccgtaaaggggggtcccgggttaccccaccggttacccggtaaggggtttcctacgggtacgggtaccaacgggttcgaacccgtaggttccccgggaagggtaacccgtaaggtaacctttaccaccggtttacctaccgtaaccttacttaccgacgtacccgacgtccctaggtccacggtacctagttaacggttacttttacgtaaccgttaattttaaccgtacgtttacgaaccttaaacgttaacgttacttaaaccggtaccgttacccttagggttacccgtaaccgggtttacgggaaccccggtaaggggttaaccgtaaacggggttacggtaacggttaacccgaaccggtaaccggttggtacccgggtacctaggaaccccg

SEQ ID NO: 215718 - DNA, 442 bp, Homo sapiens
  misc_feature: GYAE6OF02I8HCG.1.34.D01.1.454.CMB.1.raw
  modified_base (261)..(261): a, c, t, g, unknown or other
  misc_feature (261)..(261): n is a, c, g, or t
  modified_base (406)..(406): a, c, t, g, unknown or other
  misc_feature (406)..(406): n is a, c, g, or t
  modified_base (408)..(442): a, c, t, g, unknown or other
  misc_feature (408)..(442): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtcaacagtaattnatatacctacgtgacgtcggcgaggacgaagtagaagacaacgaactatgcgtgcgaccactactcgtcttctactcttcccgtccactactcgaacgactacctacgtcgtcgacgcggcgtcggacgaacggacgacactagnannnnnnnnnnnnnnnnnnnnnnnnnnnnnnnnnnn

SEQ ID NO: 215719 - DNA, 581 bp, Homo sapiens
  misc_feature: GYAE6OF02IXBLK.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctcagatcgtagtctagtggtgcatccagattgcaaggtgggtcccatccgaggttcagtggcagtgcatcgtgggacagtattacactctcactatcagcagcctgcagcctgaagtnttttgactaatttacttactagttacaacgtagttaattaacgttaaccgttaccccgttaggtacgggttaacccggtttccgggtacccggtaaacggggggtaaccgtaaacggggttacggggtaaaaccgttacccggaaacccgggtaaaccgttgggtacggtaccgtacggtaacccg

SEQ ID NO: 215720 - DNA, 503 bp, Homo sapiens
  misc_feature: GYAE6OF02GV7U3.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgttacaactagttaattaatacgttaccctacgtcggtacgttcgggcacggggacctaaggtcggaagtacgaaccgtactgtcggcgtgacc

SEQ ID NO: 215721 - DNA, 551 bp, Homo sapiens
  misc_feature: GYAE6OF02JAGYF.1.34.D01.1.454.CMB.1.raw
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtncatccagattgcaaggtgggtacccatccaggttcagtggcagtgcatcgngggacagtattacactctcactatcagcacgctgcagtcctagaattagttttcgacttaattttacttacgtgttactaactagtttaattaacttacgttaccccgttaggttacggtaccgtttaccggccggtaacggggaaccgtaaagggttcggaaacgtacgaaaccggtacgtggtcggtacctggtaaccc

SEQ ID NO: 215722 - DNA, 507 bp, Homo sapiens
  misc_feature: GYAE6OF02HXEP1.1.34.D01.1.454.CMB.1.raw
  modified_base (395)..(395): a, c, t, g, unknown or other
  misc_feature (395)..(395): n is a, c, g, or t
  modified_base (502)..(502): a, c, t, g, unknown or other
  misc_feature (502)..(502): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcgaaggtcgggtcccatccaggttcagtggcagtgcatctgggacagattacactctcactatcagcagcctgcagcctagaagtntttgacttaatttatactgtacaatgttaatactacgtaccctagtcgacgttcggaccgagggaccaagggttacgaagttacgaaccgtaacgttggtacggtcngtacc

SEQ ID NO: 215723 - DNA, 389 bp, Homo sapiens
  misc_feature: GYAE6OF02GB7IO.1.34.D01.1.454.CMB.1.raw
  modified_base (377)..(377): a, c, t, g, unknown or other
  misc_feature (377)..(377): n is a, c, g, or t
  modified_base (383)..(389): a, c, t, g, unknown or other
  misc_feature (383)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatctccgccatctgaacgcactcgtctgagcgggctggcaaggcncatagnnnnnnn

SEQ ID NO: 215724 - DNA, 533 bp, Homo sapiens
  misc_feature: GYAE6OF02F52BC.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggatacagagtcaccatcacttgccgggcgagtcaggccatcagcgattcttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctagaagtattttgactaattttattacttgtactaactagtaattactaacgttacccctacggttggaccgtttcgggcccgtaaggggaacctaaggggtacggaaacgttaccgaaaccggtaacgttggtacgggtctagaccg

SEQ ID NO: 215725 - DNA, 495 bp, Homo sapiens
  misc_feature: GYAE6OF02JGYFT.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctagaagtattttgactaattttatactgtacaatagttattatacgtaccctagtcggccgttcggccgtagggaccaagggtcgaagtccgaacgactggtcggctgac

SEQ ID NO: 215726 - DNA, 523 bp, Homo sapiens
  misc_feature: GYAE6OF02I7IXU.1.34.D01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
  modified_base (346)..(346): a, c, t, g, unknown or other
  misc_feature (346)..(346): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggnagtcaggccatcagcgattcttagcctggttncagcagaaaccagggcgacgcccctnagatcgtagtctatggtgcatccagattgcaaggtcggtcccatccgaggttcaggtggctaggtncatcgtgggacagtacttacactctcactatcagtcagcctgcagcctagaagtatttgacttaatttactacgtgtacaactagttaattactacgtacccttagtcggtaccgttcggaccgtaagggaccgtaaggtacggaacgtaccgaacgtacctggtacgcgtgtaccg

SEQ ID NO: 215727 - DNA, 532 bp, Homo sapiens
  misc_feature: GYAE6OF02IJ02K.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcggtagtctatggtgcatccagattgcaaggtcgggtcccatccaggttcagtggcagtgcatcgtgggacagattacactctcactatcagcagcctgcagcctagaagtattttgactaatttattactgtactaactagttaattagtaaccgtaccccttaggtcggtaccgtttcggaccggtaagggaccgtaaagggtcggaacgtaccgaaccggtacgtggtacggtccgtagaccc

SEQ ID NO: 215728 - DNA, 547 bp, Homo sapiens
  misc_feature: GYAE6OF02GFWXD.1.34.D01.1.454.CMB.1.raw
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttggggggacgtcacgacccgtgttccaggacactagcattggacatgagggtccccgctcagctcctggggctcctgctgctcttgggctcccaggtaccaggtctgtgacttaagtccaattgacccagtctccatcctccctgtctgcgatctattggagacaggaactcaccatcacttgccggcagtcaggccatcagtcgattctttagcctggttncagcagaaaccngggcagcccctgagatcgtagtctagtgtncataccagattgcgaaggtcgggtacccatccaggttcagtcggcgaggtcgctactcgtagggacacgattacactcacactatcagcacgcctagcagcctagaagtgtttagactaatttactactgtacaatattatagtacgtaccctaggtcggacgttcgggccgtacggggaccgaagggttcggaacgtaccgaaccggacgttgggacgtcgtcgtacccg

SEQ ID NO: 215729 - DNA, 548 bp, Homo sapiens
  misc_feature: GYAE6OF02GY8VH.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcgaagggtcgggtcccatccgaggttcagtggcagtgcatcgtgggacagtattacactctacactatcagcacgcctgcagcctagaagtattttgacttaatttattactgtactaacgtagttaattaactaacgttaccccttaggtcggtaccgtttccgggaccgtaacggggtaacctaagggtacggtaaacgtaccgaaaccggtaacgtgggtacggtacctaggaccc

SEQ ID NO: 215730 - DNA, 498 bp, Homo sapiens
  misc_feature: GYAE6OF02GMK8H.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccagtccaggttcagtggcagtgcatctgggacagattacactctacactatcagcagcctgcagcctgaatattttgctaatttattactgtacaactagttattatacgtaccctagtcggtacgttcggccgagggaccgaagggtcggaagtcgaaccgaactggtcgctgacc

SEQ ID NO: 215731 - DNA, 527 bp, Homo sapiens
  misc_feature: GYAE6OF02HJW5N.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaaatttattactgtacaactagttaattatacgttaacccctaggtacggtacgttccgggaccgaggggtaaccaagggtcggaaagtccgaaaccggaacgttggtacggtacctggtaacccg

SEQ ID NO: 215732 - DNA, 503 bp, Homo sapiens
  misc_feature: GYAE6OF02FXTC0.1.34.D01.1.454.CMB.1.raw
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactcncactancagcagcctgcagcctagaatattttgactaatttattactgtacaactagtattatacgtaccctagtggtacgttcggaccgagggaccgaaggtaggaacgtacaacggtaactggtcggactggacc

SEQ ID NO: 215733 - DNA, 524 bp, Homo sapiens
  misc_feature: GYAE6OF02IZI9A.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttggggaggtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccaggcgagcccctcagatcgtagtctatgtgcatccagattgcaaggtcgggtcccaatccaggttcagtggcagtgcatctgggacagattaacactctacatatcaagcaggcctgcagcctagaacgtnttttgactaattttatactgtacaactagtaacttataacgttaccctagtggtaccgttcggaccgtaagggtaccgaaagtagggtaaacgtcgtaaaccggaacttacggtaggtcgtagtaaccg

SEQ ID NO: 215734 - DNA, 394 bp, Homo sapiens
  misc_feature: GYAE6OF02JIP4S.1.34.D01.1.454.CMB.1.raw
  modified_base (378)..(378): a, c, t, g, unknown or other
  misc_feature (378)..(378): n is a, c, g, or t
  modified_base (384)..(394): a, c, t, g, unknown or other
  misc_feature (384)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgccatctgaacgcactcgtctgagcgggctggcaaggcncatagnnnnnnnnnnn

SEQ ID NO: 215735 - DNA, 391 bp, Homo sapiens
  misc_feature: GYAE6OF02GLWD4.1.34.D01.1.454.CMB.1.raw
  modified_base (385)..(391): a, c, t, g, unknown or other
  misc_feature (385)..(391): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgccatctgaacgcactcgtctgagcgggctggcaaggcgcatagnnnnnnn

SEQ ID NO: 215736 - DNA, 502 bp, Homo sapiens
  misc_feature: GYAE6OF02F9U95.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaatattttgactaatttattactgtacaactagttaattactaacgtaccctagtcggtacgttcggccgaaggggaccaaggtggaagtcaaccggtactggtcggctgacc

SEQ ID NO: 215737 - DNA, 571 bp, Homo sapiens
  misc_feature: GYAE6OF02JY551.1.34.D01.1.454.CMB.1.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtaaggacacagcatggacatgagggtccccgctcagctcctggggctcctgctgctctggcctcccaggtaccagctgtgacatccaattgacccagtctccatcctccctgtctgcatctattggagacagagtcaccatcacttgccgggcagtcaggccatcagcgattcttagcctggtgcagcagaaaccgngggcgacgcccctanagatcgtagtctagtggtgcatccagtattggacgtaagggtcggggtcccagtccgaggttcaggtcggcaggtgctatcgtaggacagtacttacactctcactatcagcacgcctgacagccgtagaagttattttagacttaatttatacgtagtactaacgtagttaacttactacgttacccgtacggtcggtaccgttcggaccggtaacggggaccgtaaagggtacggtaacgttaaccgaaacccggtagttacggtacggtccgtacgtacctaaccg

SEQ ID NO: 215738 - DNA, 518 bp, Homo sapiens
  misc_feature: GYAE6OF02G4H3N.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgctaaatttattactgtacaactagtaattataacgtaccccttagtcggtacgttcggaccaagggggtaccaaagggtcggaagtaccgaaccggtaacgttggtacggtcctgacccg

SEQ ID NO: 215739 - DNA, 541 bp, Homo sapiens
  misc_feature: GYAE6OF02GPJMN.1.34.D01.1.454.CMB.1.raw
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctcagatcgtagtctatggtgcatccagattgctaaggtgggtcccatccaggttcagtggcagtncatctgggacagattacactcnactatcagcagcctgcagcctagaagtattttgctaatttattacgtnttacaactagttaattacgttacgttaacccctagttcgggtaccgtttcgggcccgtaaggggaaccctaagggttaggtaacggttaccgaaaccggtaacgtcgggtacggtaccgtcgtaacccg

SEQ ID NO: 215740 - DNA, 519 bp, Homo sapiens
  misc_feature: GYAE6OF02HMNIO.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctggggacagattacactctcactatcgagcagccctgcagccttgaagtattttgctaattttattactgtacaacagttattatagtacccctgtcggacgtttccgggacctagggggaccctaagggtcggaaagtaccaacccggtaactcggtacgggcttggaccc

SEQ ID NO: 215741 - DNA, 531 bp, Homo sapiens
  misc_feature: GYAE6OF02IR7JV.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcgaaggtcgggtccatccaggttcagtgcagtgcatcgtgggacagattacactctacactatcagcagcctgcagcctgaagtatttgactaatttattactgtacaactagttattatacgttacccctaggtacggtaccgttcggccgaacgggggaccaaagggtaggaagtaccaaccgtaactggtggacctggaccacctattcgtacggttcttccgtacttcccgttacccgtacc

SEQ ID NO: 215742 - DNA, 523 bp, Homo sapiens
  misc_feature: GYAE6OF02I4GPY.1.34.D01.1.454.CMB.1.raw
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (495)..(495): a, c, t, g, unknown or other
  misc_feature (495)..(495): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatgggtgcatccagattgcaagggtcggggtcccatccgaggttcaggtggcagtgcagtctgggacagtacttacactctcactatcagcagcctgcagcctagaatntttgactaatttattactgtactaanagttattacttaacgtacccgttagtggtaccgttcggaccgacggggaccaaggtgaacgtaccgaaccgagtggtaggctgacctaccntctcggttcttcgacttcctcccgtacc

SEQ ID NO: 215743 - DNA, 484 bp, Homo sapiens
  misc_feature: GYAE6OF02G5DSS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagtattatacgtaccctagtcgacgttcggccgagggacaaggtgaagtcaaccgatgtggctgac

SEQ ID NO: 215744 - DNA, 517 bp, Homo sapiens
  misc_feature: GYAE6OF02HRG4P.1.34.D01.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctatggtgcatccagattgcaaggtgggtcccatccaggttcagtggcagtgcatcgtagggacaggacttacactctctaactatcagcagcctgcacgcctagaagttatttgacttaattttattactgtacaactattatatacgtacccctagtcggacgttcggaccgagggaccaagggtgaacgtcaacgtactggtcggctgaccacctatcgttcggtctttcacttccttacccctaccc

SEQ ID NO: 215745 - DNA, 387 bp, Homo sapiens
  misc_feature: GYAE6OF02GZB4H.1.34.D01.1.454.CMB.1.raw
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (381)..(387): a, c, t, g, unknown or other
  misc_feature (381)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgaactgtggctgcaccatctgtcttcatcttcccgcatctgaacncactcgtctgagcggctggcaaggcncatagnnnnnnn

SEQ ID NO: 215746 - DNA, 525 bp, Homo sapiens
  misc_feature: GYAE6OF02IMO0N.1.34.D01.1.454.CMB.1.raw
  modified_base (281)..(281): a, c, t, g, unknown or other
  misc_feature (281)..(281): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctnagatcgtagtctagtggtgcatccagtattggacgaagggtcgggtcccagtccgaggttcagtggcagtgcatcgtgggacagtattacactctcactatcagcagcctgcagcctagaatntttacgacttaatttacttactacgtactaactagtttaattataagtacaccgttagtcggtaacggttcggaccggagggaaccgaagggtagaacgtcgaaccgagtcggtagctcgg

SEQ ID NO: 215747 - DNA, 535 bp, Homo sapiens
  misc_feature: GYAE6OF02FO7MO.1.34.D01.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccngggcagcccctnagatcgtagtctatggtgcatccagattgcaagggtcgggtcccagtccaggttcaggtggcagtgcatcgtgggacagtattacactctacactatcagcagcctgcagcctagaagtatttgacttaatttacttactgttacaacgtagttattacttaccgtaccctaggtcgtaccggttcggaccgaacggggtacctaagggtacgtaacgtaccgaaccggtacgttgggtacggtacctaggaccc

SEQ ID NO: 215748 - DNA, 497 bp, Homo sapiens
  misc_feature: GYAE6OF02H5O25.1.34.D01.1.454.CMB.1.raw
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctatggtgcatccagattgcaagggtcgggtcccatccaggttcaggtggcagtncatcgtgggacagattacactctcactatcagcagcctgcagcctagaagtattttagctaatttattactgtacaactagttattatacgttacccctagtcgtacgttcggccaaggggaccaaggtgaagtcaacgactgtcggctgacc

SEQ ID NO: 215749 - DNA, 392 bp, Homo sapiens
  misc_feature: GYAE6OF02IR0YY.1.34.D01.1.454.CMB.1.raw
  modified_base (384)..(392): a, c, t, g, unknown or other
  misc_feature (384)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgacgcgggctggcaaggcgcatagnnnnnnnnn

SEQ ID NO: 215750 - DNA, 388 bp, Homo sapiens; identical to SEQ ID NO: 215542
  misc_feature: GYAE6OF02G0IP6.1.34.D01.1.454.CMB.1.raw
  modified_base (383)..(388): a, c, t, g, unknown or other
  misc_feature (383)..(388): n is a, c, g, or t

SEQ ID NO: 215751 - DNA, 529 bp, Homo sapiens
  misc_feature: GYAE6OF02FUB8U.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctcagatcgtagtctatggtgcatccagattgcaaggtgggtcccatccaggttcagtggcagtgcatcgtgggacagattacactctcactatcagcagcctgcagcctagaagtatttgactaatttattactgtacaacagtattactacgttacccctacgttcggtacgttccggcgtaggggaccaaaggtggaagtaccgaaccgtaacgtaggtcggtacttcgacctacctagttcttcgttaccttccacttcccgttcccgtaccc

SEQ ID NO: 215752 - DNA, 560 bp, Homo sapiens
  misc_feature: GYAE6OF02JQ3RO.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccngggcgagcccctnagatcgtagtctagtggtncatccagtnttgacgtaagggtcgggtcccatccgaggtttcagtggcagtcgctagtcgtgggactagacttacacttctacaacgtatcagcacgctggcagcctagaaagtnttttgacttaattttactacgtgtaacaactagttaatttaactacgttaccccgtaggttacggtacggttaccggaccggaaggggtacctaagggtacgaacgtaccgtaaccggtaaccgttggtacggtccgtagtacccg

SEQ ID NO: 215753 - DNA, 517 bp, Homo sapiens
  misc_feature: GYAE6OF02H4YCD.1.34.D01.1.454.CMB.1.raw
  modified_base (279)..(279): a, c, t, g, unknown or other
  misc_feature (279)..(279): n is a, c, g, or t
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttgccgggcgagtcaggccatcagcgattctttagcctggttgcagcagaaaccagggcagcccctnagatcgtagtctatggtgcatccagattgcaaggtgggtacccatccagttcagtggcagtgcagtcgtgggacagattacacttctcactatcagcagcctgcagctagaagtnttttgacttaaattttattactgtaccaatagttaattaactacgttaaccccttagttcggacgtttcgggacgtaacggggacaaggtacgaagtaccgaaccgacgttgtggtctgaccg

SEQ ID NO: 215754 - DNA, 517 bp, Homo sapiens
  misc_feature: GYAE6OF02GUXME.1.34.D01.1.454.CMB.1.raw
  modified_base (254)..(254): a, c, t, g, unknown or other
  misc_feature (254)..(254): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttncagcagaaaccagggcgagcccctcagatcgtagtctagtggtgcatccagtattgcgaagggtcgggtcccagtccgaggttcagtggcagtgcatcgtgggacagtacttacactctacactatcagcagcctgcagcctagaattnttttgacttaaatttacttactgtacaatagttaattactaccgtaccctagtcggtacgttcggaccgagggtaccaagggtcggaagtaccgaacgtacgtggtggctgacc

SEQ ID NO: 215755 - DNA, 505 bp, Homo sapiens
  misc_feature: GYAE6OF02II4WM.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccagtccaggttcagtggcagtgcatcgtgggacagattacactctcactatcagcagcctgcagcctagaagtntttgacttaatttattactagtacaactagtattatacgttaccctagtcggtacgttcggctagggacctaaggtggaacgtcgaaccgtacgtggtacggtctagacc

SEQ ID NO: 215756 - DNA, 573 bp, Homo sapiens
  misc_feature: GYAE6OF02H8AJG.1.34.D01.1.454.CMB.1.raw
  modified_base (354)..(354): a, c, t, g, unknown or other
  misc_feature (354)..(354): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccgagggcgagccccctcagactcggtagtctatggtgcatccagattgacgaagggtcgggtcccagtccaggttcagtggcaggtnacagtcgtaggggactagattaccactctcactatcagcacgtcctgcacgcctagtaacgtattttagacttaaattttactactgtactaactagttaattacgtaacgttaccccgtaggttacgggtaccgtttccgggaccggaacggggtacctaaaggggttacggaacgttaccggaaaccggtaacgttgggtacggtaccgtgtaaccc

SEQ ID NO: 215757 - DNA, 647 bp, Homo sapiens
  misc_feature: GYAE6OF02GIFKF.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccggtcggacgtacgacggaccgactactacgacggacttacttttacgttccgtcggttggtcacgacgacgaaaaccgaacgggcgggacgaccccgtccctagagtacgtacggttctacttaggtggcgactaccacgagttgtcgaaggtagggggtcccgactaccgtacggttacgtagtggcgagtgcatcgtgggacgagagttactactctctactattacacgcacgacctgtcgacgccgtcgtaaaggtacttttggtacaaatttttaagtttactcgttactaacgtaagtttatttaacgttaacgttaccccgtaacgttgggtacgtttccgggaccgaacggggtaccgaaaggttagggaacgtacctaacccgaagttcggtgggacctcgcctaaccacgttcgttcggttcttctacttccttccccgtaccg

SEQ ID NO: 215758 - DNA, 480 bp, Homo sapiens
  misc_feature: GYAE6OF02IKTTY.1.34.D01.1.454.CMB.1.raw
  modified_base (457)..(457): a, c, t, g, unknown or other
  misc_feature (457)..(457): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcgagccccctcagatcgtagtctatggtgcatccagattgcaaggtgggtcccatccaggttcagtggcagtgcatctgggacagattacactctacactatcagcagcctgcagcctgaagtatttgactaatttattactgtacaatagttattatacgtaccctagtggacgttcggccagggaccaggtgaagtcaacgatgtgcngcacatctgtctcactcctccgc

SEQ ID NO: 215759 - DNA, 496 bp, Homo sapiens
  misc_feature: GYAE6OF02F7G4M.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtcgggtcccatccaggttcagtggcagtgcatctgggacagattacactctcactatcagcagcctgcagcctgaatattttgactaatttattactgtcaactagtattatacgtaccctagtcgacgttcggaccgagggaccaagggtacgaagtacaaccggaactggtaggctgacc

SEQ ID NO: 215760 - DNA, 486 bp, Homo sapiens
  misc_feature: GYAE6OF02GSP2E.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgctaatttattactagtcaactagttattatacgtaccctagtgacgttcggcgagggaccaaggtgagtcgaacgactgtcgctgacc

SEQ ID NO: 215761 - DNA, 509 bp, Homo sapiens
  misc_feature: GYAE6OF02HODNJ.1.34.D01.1.454.CMB.1.raw
  modified_base (281)..(281): a, c, t, g, unknown or other
  misc_feature (281)..(281): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcagcccctnagatcgtagtctatggtgcatccagattgcaaggtcgggtcccatccaggttcagtggcagtgcatcgtgggacagattacactctcactatcagcagcctgcagctagaagtattttgactaaatttatactgtacaacagttaattanacgttaccctagtcggtacgtttcgggccagggaccctaagggtcggaacttcgaacggtactggtacggctaggacc

SEQ ID NO: 215762 - DNA, 542 bp, Homo sapiens
  misc_feature: GYAE6OF02FW5A3.1.34.D01.1.454.CMB.1.raw
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctagtggtgcatccagtattgacgaagggtcgggtcccagtccgaggttcagtggcagtgcagtcgngggacagtacttacnctctacactatcagcagcctgacagtcctagaagttntttgacttaatttatactgtactaacttagtacttagtaccgtacccgtagtacggtaccgttcggaaccggtacgggaaccgtaagggtacgtaacgtaccgtaaccgtaagttcggtcggactgtaccg

SEQ ID NO: 215763 - DNA, 491 bp, Homo sapiens
  misc_feature: GYAE6OF02I0SG8.1.34.D01.1.454.CMB.1.raw
  modified_base (487)..(487): a, c, t, g, unknown or other
  misc_feature (487)..(487): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagagtattttgactaatttattactgtacaactagttatatacgtaccctagtcggtacgttcggccagggaccaaggtggaagtacaacgacgtgtcgntgac

SEQ ID NO: 215764 - DNA, 530 bp, Homo sapiens
  misc_feature: GYAE6OF02G71OK.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctnagatcgtagtctatggtgcatccagattgcaaggtgggtcccatccaggttcagtggcagtgcatctgggacagattacactctcactatcagcagcctgcagcctagaagtattttgacttaattttacttactgtacaactagttaattatacgtacccctacgtggtaccgttcggaccgtaagggggaccctaaggggttcggaacgttaccgaaccggtaacttgggtacgggtcctaggacccg

SEQ ID NO: 215765 - DNA, 589 bp, Homo sapiens
  misc_feature: GYAE6OF02JYIZ1.1.34.D01.1.454.CMB.1.raw
  modified_base (234)..(234): a, c, t, g, unknown or other
  misc_feature (234)..(234): n is a, c, g, or t
  modified_base (266)..(266): a, c, t, g, unknown or other
  misc_feature (266)..(266): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (545)..(545): a, c, t, g, unknown or other
  misc_feature (545)..(545): n is a, c, g, or t
tcagacgagtgcgtcacgaccggtgctcgatttagatcgtctgtgttgggtttgggtcgatggacatgagggtcccgctcagctcctgggcgtcctgctgctctggctcccaggtaccagctgtgacatccaattgacccagtctccatcctccctgtctgcatctattggagacagagtcaccatcacgttgccgggcagtcaggccatccgagcgattctttagcctggttnacagcagaaccgaggcgagcccctacacgacngtagtctagtcggtgcatccagattgacagggtcggggtcccagtacgacggtcaggtggcaggtgcagttcgtaggacaggtattacgtctctcaactatacncgacacgctgactggcctaggaactntttgactatttattactagacaactatatttacgtaacttacccgttacgtacggttaagtccgggtaccgtacgggggtaaccctaggggtaacgtaaccggtaccgtaaccgaaccggtttggaacggttgaccgtcggtaaacccncttaacggttcgttaccgtcgttaacttcccgtcccgttaaccc

SEQ ID NO: 215766 - DNA, 390 bp, Homo sapiens
  misc_feature: GYAE6OF02G713R.1.34.D01.1.454.CMB.1.raw
  modified_base (250)..(250): a, c, t, g, unknown or other
  misc_feature (250)..(250): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (385)..(390): a, c, t, g, unknown or other
  misc_feature (385)..(390): n is a, c, g, or t
tcagacgagtgcgtcacgaccggtgctcgatttagatcgtctgtgttgggtttgggtagtcgaggccgatcagcgattctttagcctggttgcagcagaaaccaggcgagccctcagatcgtagtctatggtgcatccagattgcaaggtgggtcccatccaggttcagtggcagtgcatctgggacagattacactctcactatcagcagcctgcagcctgaagattttgcaattttatactgtcaacngttattatagtacccctagtggactttcggccaggggaccaaggtggaaagtcaacgaactgtggctgcaccatctgtcttcatccttcccgccaatctgaacgcactcgtntgagcggctgcaagggcncatgnnnnnn

SEQ ID NO: 215767 - DNA, 511 bp, Homo sapiens
  misc_feature: GYAE6OF02ICL80.1.34.D01.1.454.CMB.1.raw
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (477)..(479): a, c, t, g, unknown or other
  misc_feature (477)..(479): n is a, c, g, or t
  modified_base (481)..(511): a, c, t, g, unknown or other
  misc_feature (481)..(511): n is a, c, g, or t
tcagacgagtgcgtcacgaccggtgctcgatttagatcgtctgtgttgggtttgggtagtcgaggccatcagcgattctttagcctggttgcagcagaaaccagggcgagccctcagatcgtagtctatggtgcatccagattgcaaggtggggtcccatccaggttcagtggcagtgcatctgggacagattacactctcactatcagcagcctgcagtcctgaagattttgcaattttatactgttcaactagttattatagtaacccctagtggaacgttcggccaggggaccaaggtcggaagtccaaaccgaactggtggacctggaccaccgattcgtgttccttacattacctttccccggctaacgtcttacggaaaccgcctaaccgtttccgtaccttggaacggtccgggggcccttgggaccgaaacgggtccggaaccaacgttaagggncgtcncgtngcgcnnncnnnnnnnnnnnnnnnnnnnnnnnnnnnnnnn

SEQ ID NO: 215768 - DNA, 390 bp, Homo sapiens
  misc_feature: GYAE6OF02IXEP3.1.34.D01.1.454.CMB.1.raw
  modified_base (376)..(376): a, c, t, g, unknown or other
  misc_feature (376)..(376): n is a, c, g, or t
  modified_base (382)..(390): a, c, t, g, unknown or other
  misc_feature (382)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgaactgtggctgcaccatctgtcttcatcttcccgccatctgaacgcactcgtctgagcggctggcaaggcncatagnnnnnnnnn

SEQ ID NO: 215769 - DNA, 556 bp, Homo sapiens
  misc_feature: GYAE6OF02IMGDK.1.34.D01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctgggttncagcagaaaccagggcgagcccctnagatcgtagtctatggtgcatccagtattgcaagggtgggtcccatccaggttcagtggcagtgcagtcgtgggacaggactttacactctcaacttancagcagcctgccagcctagaaagtntttgactaatttattacttgtacaactagttattatacgtacccttaggtgtaccgttcggaccgtagggaacctaagggtacgaaggttaccgaaccggtaacgtcggtacggtacgtacggtacctaaccgtacttcgtacggttaccttccgtactttccccgttcccgtaccg

SEQ ID NO: 215770 - DNA, 388 bp, Homo sapiens
  misc_feature: GYAE6OF02IN253.1.34.D01.1.454.CMB.1.raw
  modified_base (379)..(388): a, c, t, g, unknown or other
  misc_feature (379)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtacccctagtggacgttcggccaggggaccaagggtggaagtcaaccgaactgtggctgcacatctgtcttcatcttccacctctcacgcactcgctgagcgggctggcaaggcgcatagnnnnnnnnnn

SEQ ID NO: 215771 - DNA, 489 bp, Homo sapiens
  misc_feature: GYAE6OF02HRQZL.1.34.D01.1.454.CMB.1.raw
  modified_base (483)..(483): a, c, t, g, unknown or other
  misc_feature (483)..(483): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgctatcgtgggacagattacacttctctactatcagcagcctgcagcctagaagtattttcgactaatttattactgtacaactagttatatacgtaccctagtcgtacgttcggctagggacaaggtgagtcaacgatgngctgac

SEQ ID NO: 215772 - DNA, 522 bp, Homo sapiens
  misc_feature: GYAE6OF02HU8OD.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattctttagcctggttgcagcagaaaccagggcagcccctcagatcgtagtctatggtgcatccagattgcaaggtcgggtcccatccaggtttcaggtggcagtgcatcgtgggacagattacactctcactatcagcagcctgccagcctgaatntttgacttaatttattactgtacaactgttattatacgtacccctagtggaccgtttcggaccgtaaggggtaccaagggttacggaacgttaccgaaccggtaacgttcggtacggctcggtacccg

SEQ ID NO: 215773 - DNA, 552 bp, Homo sapiens
  misc_feature: GYAE6OF02JQQSI.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctagtggtgcatccagattgacaaggtcgggtcccatccgaggttcaggtggcagtgcatcgtgggacagattacatctcactatcagcagcctgcagcctagaacgttattttggacttaaattttacttacgtacgttacaacttagttattaacgtacgttaccctaggttaggtaccggtttacggaccggtaacggggacctaacgggttagggaacgttacgaaaccggtacctgggtacggtacgtgtaacccg

SEQ ID NO: 215774 - DNA, 490 bp, Homo sapiens
  misc_feature: GYAE6OF02JA9EQ.1.34.D01.1.454.CMB.1.raw
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtnttttgactaattttatactgtacaactagttatacttaagtaccctagtgacgttcggccgtaggggaccaaggtgaagtcaacgactgtggctgacc

SEQ ID NO: 215775 - DNA, 533 bp, Homo sapiens
  misc_feature: GYAE6OF02G7DBM.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcgaaggtcgggtcccatccgaggttcagtggcagtgcatcgtgggacaggattacactctcactatcagcacgcctgcagcctagaagtatttgacttaatttacttactagtacaatagttaattactacgttaccccgttagtcggttacgtccgggtaccgaacggggtacctaacgggtagaacggtaccgaacggtaacgttggtacggactggtaccc

SEQ ID NO: 215776 - DNA, 384 bp, Homo sapiens
  misc_feature: GYAE6OF02IBAFT.1.34.D01.1.454.CMB.1.raw
  modified_base (378)..(384): a, c, t, g, unknown or other
  misc_feature (378)..(384): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcggccaggggaccaaggtggaagtcaacgactgtggctgcacatctgtcttcatcttccgcatctgaacgcactcgtctgagcgggctggcaaggcgcatagnnnnnnn

SEQ ID NO: 215777 - DNA, 483 bp, Homo sapiens
  misc_feature: GYAE6OF02I6U0B.1.34.D01.1.454.CMB.1.raw
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtgggtcccagtccaggttcagtggcagtgcatcgtgggacagattacactctcactatcagcagcctgcagcctgaagtatttgactaatttattactgtacaatagttaattactagtacccctagtggtacgttcggccgagggaccaaggtgaacgtcacgatgtggctgcacntctgtctnatctccgac

SEQ ID NO: 215778 - DNA, 538 bp, Homo sapiens
  misc_feature: GYAE6OF02JDCBA.1.34.D01.1.454.CMB.1.raw
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtggcagtgcatcgtgggacagtacttacactctctactatcgagcacgcctgcacgcgtagaagttntttgacttaatttatacgtgtactaactagttacttaacgtaccgttacccttaggtacggtacggttccggaccggaacgggtacgtaagggtacggtaacgtaccgaaccggtacgtcggtacgtcgtacgtacc

SEQ ID NO: 215779 - DNA, 919 bp, Homo sapiens
  misc_feature: GYAE6OF02GPX83.1.34.D01.1.454.CMB.1.raw
tcagacgagtgcgtcacgaccggtgctcgatttagatcgtctgtgtttggggttttggggggagtcagacccctacgtcgaggacacagcagtggacatggacggtcccgctcagctcctggggctcctgctgctcgtgctcccaggtaccacgctgtgacatccaacttgacccagtcctcatcctcctgtcctgcatctattgagacgagacgtcacctataccacttcgaccgggtcgacgtcgacggccatcgacgacgtattactttacgaccttaggtttagtcgtagtccaaggaaaacccgaaggggaaccgaacgggacccccctacgaacccggtaaacgttccggttaacgttccgtaacgttccgggtacggacctaacgttcccgtaaggtactttaggttacggtaaaacgggggtttcggggggttacccccaagtttacccgtaaagggtttaccgtaacgggttacggggtacgtaacggttacggtaccgtaacgtttcccggttaggggggaaacccttaagggtttaaacttttttaaacccgtaaacccgtttaaccttaaccctaaacccgtttaacgttaccgaaacgggtacccggtaaacggtacccgttaggttacccgtaacggtacccgttaacggtaaacggtttaacttttttacgggaaccttttaaaactttttaaacgtttaaaccgtttaggtttaacctaaacgtttaacgtttaacttttaaaccgttaaccgtttaacccccgttaacgggtttaccggggtaacccggttttaccggggaaacccggtaaacgggggttaacccggtaaaggggttacggtaaaccggttaaccgtaaacccgggttaacgttacgggtacggttaccgtacggtaacccg

SEQ ID NO: 215780 - DNA, 500 bp, Homo sapiens
  misc_feature: GYAE6OF02HQSZN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgagcccctcagatcgtagtctatggtgcatccagattgcaaggtcgggtcccatccaggttcagtggcagtgcatcgtgggacagattacactctcactatcagcagcctgcagcctagaagtattttgacttaatttattactagtacaactagttattatacgtaccctagtcgtacgttcggcgagggaccaaggtcgaagtcaaccgaactggtcggctgacc

SEQ ID NO: 215781 - DNA, 595 bp, Homo sapiens
  misc_feature: GYAE6OF02FNN9O.1.34.D01.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggtgcagcagaaaccngggcagcccctanagatcgatctatggtgcatcagattgcgaaggtgggtcccatccaggttcagtggcagtgcatcnggganagattacactctacactatcagcagcctgcagtcctggaaagtntttttagacttaaacgttttaatttacctgttacctaaactaacggtttaactttaaacgttaccggtaaacccccgtttacgttacggggtaaccggttttacccgggacccggtaacgggggaaccccgtaaaaggggttcgggaaaacggtttccgaaaacccggtaaaccgtggttaccgggtaccgtacgtaacccg

SEQ ID NO: 215782 - DNA, 516 bp, Homo sapiens
  misc_feature: GYAE6OF02HTEAX.1.34.D01.1.454.CMB.1.raw
  modified_base (280)..(280): a, c, t, g, unknown or other
  misc_feature (280)..(280): n is a, c, g, or t
  modified_base (413)..(413): a, c, t, g, unknown or other
  misc_feature (413)..(413): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagatttggacgtaagggtcgggtccccaagtccgaggttcaggtggcagtgcagtcgtgggacagtattacgactctacactatcagcagcctgaccagccttagaagtnttttgacttaaatttattactgtactaactagtattactaacgttaccctagtcgtacgttcggcgaggacgaaggtagaagtcaacgacgtggtagctgacc

SEQ ID NO: 215783 - DNA, 483 bp, Homo sapiens
  misc_feature: GYAE6OF02G3M00.1.34.D01.1.454.CMB.1.raw
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtggggtcccatccaggttcagtggcagtgcatctggggacagattacactctcactatcagcagcctgcagcctgaagtatttgactaatttattactgtacaactagtattatacgtaccctacgtggtacgttcggcagggaccaaggtgaagtcacgactggtggctgcaccatctgtctnactctcccgc

SEQ ID NO: 215784 - DNA, 515 bp, Homo sapiens
  misc_feature: GYAE6OF02ICZMW.1.34.D01.1.454.CMB.1.raw
  modified_base (221)..(221): a, c, t, g, unknown or other
  misc_feature (221)..(221): n is a, c, g, or t
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgtgggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggngagtcaggccatcagcgattctttagcctggttgcagcagaaaccagggcgacgcccctnagatcgtagtctatggtgcattccagattgcaaggtcgggtcccatccgagtcagtggcagtgcatcgtggacagattacgacttcncatatcagcagcctgcagcctagtaagtnttttgacttaattttatacgtgtacaactgttaattagtacgtaccctagtacggtaccgttcgggaccgacggggaccgtaaggtaggtaacgtcaaaccgtacgtagtcggctacg

SEQ ID NO: 215785 - DNA, 550 bp, Homo sapiens
  misc_feature: GYAE6OF02H2EU2.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatctggggacagattacactctacatatcagcacgcctgcagcctagaagtattttgacttaaattttacttactcgttacaacttagttaattacgttaacgttaccccttaaggtcggtaaccgtttcgggcccgtaacgggggtaccaaagggttaggaaacgttaccgaaccgtaacgttcggtacgggtacctgtaaccg

SEQ ID NO: 215786 - DNA, 542 bp, Homo sapiens
  misc_feature: GYAE6OF02GY6Z9.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggcgagcccctnagatcgtagtctatggtgcatccagattgacgaagggtcgggtcccagtccgaggttcaggtggcagtgcatcgtgggacagtattacactctacactatcagcagcctgcagcctagaatatttgacttaatttacttactgtacaactagttaattactaaccgttaccctagttcggtaccgttcgggaccgtaacggggtaaccgtaagggtacggaacgttaccgaaccggtaacgtggtacggtccgtagtaccg

SEQ ID NO: 215787 - DNA, 493 bp, Homo sapiens
  misc_feature: GYAE6OF02IXPPS.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgacaaggtgggtcccatccaggttcagtggcagtgcatctgggacagattacactctcactatcagcagcctgcagcctagaagtattttgactaatttattactgtacaactagttaattatacgtaccctagtagtacgtcggccgagggacaaggtgaacgtcgaaccgatggtgactgac

SEQ ID NO: 215788 - DNA, 619 bp, Homo sapiens
  misc_feature: GYAE6OF02J1C6M.1.34.D01.1.454.CMB.1.raw
  modified_base (249)..(249): a, c, t, g, unknown or other
  misc_feature (249)..(249): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtcctccatcctccctgtctgcatctattggagacagagtcaccatcacgttggccgggcgagtcaggccatcagcgtattcttagcctggtcgcagcaacgaaaccgngggccgacgcccctgagatcgtagtctagtggtcgacatccgagtattcggacgtaagggtcggggtacccagttccgagggtttcaggtcggactaggtcgactagttcgtaggggaacctaggtaacttaccacttcctacactactacacgcacgcctgaccagtcctagattntttagacttaattttatactgtaacaatattacttacgtacgttacccgtaggtcggtaccggttcggacgtaacggggtaccaagggtacgtaacgtaccgaaccggtacgtggtacggtacttaccggacccttaaccgtagtttccggttacgtttacccttccgtaacgtttccccgttacccgtaccg

SEQ ID NO: 215789 - DNA, 532 bp, Homo sapiens
  misc_feature: GYAE6OF02JYT0U.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgacgcccctnagatcgtagtctagtggtgcatccagtattgacgtaagggtcgggtcccaagtccgaggttcaggtcggcagtgcagtcgtagggacagacttacacgttctacactatacagcagcctgcagcctagagtatttgactaatttatactagtacaactagttaattagtaccgttaccctacggtagtacggttccggaccgaacggggactaagggtagaacgtacgaaccgtaagtggtacggctgtacc

SEQ ID NO: 215790 - DNA, 534 bp, Homo sapiens
  misc_feature: GYAE6OF02G3FH4.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagccttggttgcagcagaaaccagggcgacgcccctgagatcgtagtctagtggtgcatccagtattgcgaagggtcgggtacccatccgaggtttcaggtcggcagtcgcagtcgtagggacagtacttacgactctcactatcagcacgctgcagcctagaatatttagacttaatttacttactgtacaacttagttattaataccgtaccctagtcggtaccggttcggccggtaagggaaccgtaggtaggaacgtacgaacgaacgtggtacggtctcgacc

SEQ ID NO: 215791 - DNA, 521 bp, Homo sapiens
  misc_feature: GYAE6OF02GKLH5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctagtggtgcatccagattgacgaagggtcgggtcccagtcctaggttcagtggcagtgcatcgtgggacagtattacactctcactatcagcagcctgcagcctagaagtattttgacttaatttacttactgtactaactagttaacttatacgtaccctagtgtacgttcggacgacggggacctaagggtacggaacgtaccgaacgtacgtggtacggctgacc

SEQ ID NO: 215792 - DNA, 511 bp, Homo sapiens
  misc_feature: GYAE6OF02IT0WW.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctagaagtattttcgactaaattttattactgtacaactattattatactacccgtagtcggtacgttcggaccgagggacctaaggtaggaacgtacgaaccggtacgtacggtcgtcgtagacc

SEQ ID NO: 215793 - DNA, 499 bp, Homo sapiens
  misc_feature: GYAE6OF02HQWT4.1.34.D01.1.454.CMB.1.raw
tcagacgagtgcgtcacgaccggtgctcgatttagatcgtctgtgttgggtttgggggagtcagaccatgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtcggggtcccagtccaggtttcagtggcagtgcatctgggacagattacactctcatatcagcagcctgcagcctagaagtattttgactaattttatactgtacaacagtattatacgtaccctagtggtacgttcggaccgagggacctaaggtggaacgtacaaccgtaactggtaggctcg

SEQ ID NO: 215794 - DNA, 545 bp, Homo sapiens
  misc_feature: GYAE6OF02JAFUE.1.34.D01.1.454.CMB.1.raw
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctcagatcgtagtctatggtncatccagattgcaaggtcgggtcccatccaggttcagtggcagtgctatcgtgggacagtattacactctcgactatcagcagcctgcagtcctagaacgtattttcgacttaattttattactagttactaacgtagttaacttattaacgttaccccttaggtcggtacggttaccggccggtaagggtaccgaagggttacggaacgtaccgaaccggtaccgtcggtacgtcgacgtaacccg

SEQ ID NO: 215795 - DNA, 580 bp, Homo sapiens
  misc_feature: GYAE6OF02JD2WM.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcacgaccctgtcacggacacacgcatggacatgagggtccccggctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagtattgcgaagggtcgggtcccatccgaggttcaggtggcagtgcatcgtgggacagtattacactctcactatcagcagcctgcagcctagaagtcttttgacttaaagttttattacgtcgttacctaaactagtttaattaacgttaacgttaccccttacggttcgggtaaccggtttccgggacccggtaacgggggtaaccctaaaggggtacgggtaaacggttaccgaaacccggttaacgttgggtacggtccgtagacccg

SEQ ID NO: 215796 - DNA, 500 bp, Homo sapiens
  misc_feature: GYAE6OF02I49WI.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtcgggtcccagtccaggttcagtggcagtgcatcgtgggacagtattacactctcactatcagcagcctgcagcctagaagtattttgacttaatttattactgtacaactagttattatacgtaccctagtcgtacgttcggcgagggaccaaggtgaagtacgaacgtacgtggtcgctagcc

SEQ ID NO: 215797 - DNA, 511 bp, Homo sapiens
  misc_feature: GYAE6OF02F3KBE.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtcgggtcccatccaggttcagtggcagtgcatcgtgggacagattacactctcactatcagcagcctgcagcctgaagtnttttagacttaatttattactagtacaactagttaattactaacgtaccctagtcggtacgttcggacgagggaccgaaggtacggaagtacgaaccgtaacgtggtacgtctgacc

SEQ ID NO: 215798 - DNA, 491 bp, Homo sapiens
  misc_feature: GYAE6OF02GQTT7.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtnttttgactaatttattactgtacaactagttattatacgtaccctagtggtacgttcggcgagggacaaggtgaagtcgaaccgactggtggctgac

SEQ ID NO: 215799 - DNA, 389 bp, Homo sapiens
  misc_feature: GYAE6OF02GSXTE.1.34.D01.1.454.CMB.1.raw
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
  modified_base (381)..(389): a, c, t, g, unknown or other
  misc_feature (381)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacncactcgtctgagcggctggcaggcncatagnnnnnnnnn

SEQ ID NO: 215800 - DNA, 498 bp, Homo sapiens
  misc_feature: GYAE6OF02HVATN.1.34.D01.1.454.CMB.1.raw
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctcagatcgtagtctatggtgcatccagattgcgaaggtgggtccatccaggttcagtggcagtgcatcgtgggacagattacactctcactatcagcancctgcagcctagaagtattttgacttaatttactactgtacaactagtaattanacgttaccctagtgtacgtcggcgacgggacaaggtagaacgtacaaccgtagtggtggctgac

SEQ ID NO: 215801 - DNA, 493 bp, Homo sapiens
  misc_feature: GYAE6OF02GG5OX.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgatctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagattttgctaatttattactgtcaactagtattatagtacccgtagtgacgttcggctacgggacctaaggtggaagtacgaaccgtaactgtaggctagacc

SEQ ID NO: 215802 - DNA, 544 bp, Homo sapiens
  misc_feature: GYAE6OF02IX3BO.1.34.D01.1.454.CMB.1.raw
  modified_base (281)..(281): a, c, t, g, unknown or other
  misc_feature (281)..(281): n is a, c, g, or t
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaaggtcgggtcccagtccgaggttcagtggcagtgcatcgtgggacagtacttacactctcactatcagcacgcctgcagcctagaagtnttttgacttaatttacttactgtacaactagttaattacgtaaccgtacccgttacggtacggtaccgttacgggcccgtaacggggaccgtaagggtacggtaacgtacgaaccggtaacgttggtcggtacgtaggaccc

SEQ ID NO: 215803 - DNA, 588 bp, Homo sapiens
  misc_feature: GYAE6OF02GGGM4.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggcctcccaggtaccagctgtgacatccaattcgacccagtctccatcctccctgtctgcatctattggagacagagtcaccatcacttggccgggcgagtcaggccatcagcgtattctttagccttggttgcagcaagaaaccgagggcgacgcccctcagatcgtagtctagtggtgcatccagtattgacgaagggtcgggtacccatccgaggttcaggtggcagtgcatcgtgggacagtattacactctcactatcagcacgcctgcagcctagaagtattttgacttaatttacttactgtactaacgtagttaacttaacgttaaccgttaccccgtaggttacggtaccggtttaccgggacccggtaacggggtaacccgtaaagggttacgggtaaacgttaccgaaacccgggtaacgttcgggtacgggtaccgtacggtaacccg

SEQ ID NO: 215804 - DNA, 490 bp, Homo sapiens
  misc_feature: GYAE6OF02FGYCL.1.34.D01.1.454.CMB.1.raw
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (486)..(486): a, c, t, g, unknown or other
  misc_feature (486)..(486): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgcaaggtcgggtcccagtccaggttcagtggcagtgcatcgtgggacagattacactctcactatcagcagcctgcagccgtgaatnttttnacttaatttattactgtacaactagtattatacgtaccctagtgacgttcggacgagggaccaaggtgaagtcaacgatgcgcngacc

SEQ ID NO: 215805 - DNA, 510 bp, Homo sapiens
  misc_feature: GYAE6OF02FUEQ0.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccagtccaggttcagtggcagtgcatcgtgggacagattacactctcactatcagcagcctgcagcctgaagtnttttgctaatttattactgtacaactagttattatacgttacccctagtcggtacgttcggaccgaggggacccaaggtggaagttccgaaccggtaacgtggtacggctgaccc

SEQ ID NO: 215806 - DNA, 521 bp, Homo sapiens
  misc_feature: GYAE6OF02GCAJO.1.34.D01.1.454.CMB.1.raw
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (435)..(435): a, c, t, g, unknown or other
  misc_feature (435)..(435): n is a, c, g, or t
tcagacgagtgcgtcacgaccggtgctcgatttagatcgtctgtgttgggggtttgggggagtcagaccctgtcaggacacgagcatggacatgagggtccccgctcagctcctggggcctcctgctgctctggctcccaggtaccagctgtgacatccaattgacccagtctccatcctccctgtctgcatctattggagacagagtcaccatccacttgccgggcgagtcaggccatcagcgattctttagcctggttncagcaagaaccagggcgagcccctnagatcgtagtctatggtgctatccgagattgctaagggtcgggtcccatccaggttcagtggcagtcgcatcgtgggaactagacttacactctcactatcagcagcctgcagcctagaattatttgacttaatttatactgtacaatnttaacttatacgtaccctagtggtacgtcggacgagggacccgtaaggtacggaacgtccgaaccggaacgtgtcggtacctgacc

SEQ ID NO: 215807 - DNA, 491 bp, Homo sapiens
  misc_feature: GYAE6OF02FTWBG.1.34.D01.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcagcccctcagatcgtagtctatggtgcatccagattgcaaggtgggtcccatccaggttcagtggcagtgcatcgtgggacagattacactctcactatcagcagcctgcagcctgaatnttttgctaatttattactgtacaactagttattatacgtaccctagtcgtacgttcggcgagggaccaaggtgaagtcgaacgtactgtcggctgacc

SEQ ID NO: 215808 - DNA, 520 bp, Homo sapiens
  misc_feature: GYAE6OF02JM8XZ.1.34.D01.1.454.CMB.1.raw
  modified_base (203)..(203): a, c, t, g, unknown or other
  misc_feature (203)..(203): n is a, c, g, or t
  modified_base (255)..(255): a, c, t, g, unknown or other
  misc_feature (255)..(255): n is a, c, g, or t
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
  modified_base (436)..(436): a, c, t, g, unknown or other
  misc_feature (436)..(436): n is a, c, g, or t
tcagacgagtgcgtcacgaccggtgctcgatttagatcgtctgtgttgggtttgggggtaggtcgagacccgtgtcaggacacagcatggacatgagggtcccgctcagctcctgggctcctgctgctctggctccaggtaccagctgtgacatccaattgacccagtctccatcctccctgtctgcatctagttgagacagngtcaccatcacttgccggcagtcaggccatcaagcgattcttagcctggttnccagcaagaaccagggcgacgcccctnagatccgtagtcctatggtgcattccagattgctaagggtcgggtcccattccgaggttcagtgggcagtgcatcgtgggacagattacactntacactatcagcagcctgcagtcctgaaagtnttttagcttaaatttcttactgtacaacngttaatatactacccgttagtcgttacgtcggtcgaggtaccgtaagtggtaagctaaccggtatacgggtacgcgtagtaccg

SEQ ID NO: 215809 - DNA, 539 bp, Homo sapiens
  misc_feature: GYAE6OF02JGMLO.1.34.D01.1.454.CMB.1.raw
  modified_base (141)..(141): a, c, t, g, unknown or other
  misc_feature (141)..(141): n is a, c, g, or t
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (429)..(429): a, c, t, g, unknown or other
  misc_feature (429)..(429): n is a, c, g, or t
tcagacgagtgcgtcacgaccggtgctcgatttagatcgtctgtgttgggtttggggagtcacgaccctgtcaggacacagcatggacatgagggtcccgctcagctcctgggctcctgctgctctggctcccaggtaccngctgtgacatccaattgacccagtctccatcctccctgtctgcatctattgganacagagtcaccatcacttgccgggnagtcagccatcagcgattcttagcctggttcgcagcagaaccngggcacgcccctnagatcgtagtctagtggtncatccagattgcaagggtcggtacccagtccaggttcagtggcagtgcagtcgtagggacagacttacactctaccatactcacgcacgcctgcacgcctggaattacttttgacttaagttttacttaaccgngttacaaacttagttaattaataccgtacccttaagtggtaaccggtcggtaccggagggtaccgtaaggtggtaacgttccaaaccggtactgggtacgactcgtaccg

SEQ ID NO: 215810 - DNA, 393 bp, Homo sapiens
  misc_feature: GYAE6OF02H4PZ0.1.34.D01.1.454.CMB.1.raw
  modified_base (240)..(240): a, c, t, g, unknown or other
  misc_feature (240)..(240): n is a, c, g, or t
  modified_base (378)..(378): a, c, t, g, unknown or other
  misc_feature (378)..(378): n is a, c, g, or t
  modified_base (384)..(393): a, c, t, g, unknown or other
  misc_feature (384)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttnttactgtcaacagtattatacgtacccctagtggacgttcggccaggggaccaaggtgaagtcaaccgactgtggctgcaccatctgtcttcattccttcccgcatctagaacgcactcgtctgagcggctgcaggcncatagnnnnnnnnnn

SEQ ID NO: 215811 - DNA, 494 bp, Homo sapiens
  misc_feature: GYAE6OF02H35VN.1.34.D01.1.454.CMB.1.raw
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcgaaggtcgggtacccatccgaggttcaggtggcagtgcatcgngggacagattacactctacactancagcagcctgcagcctagaagtnttttgactaattttatactntacaactattatatacgtaccctagtcgacgttcggcgacgggacaaggtgaagtcaacgagtgtgctgacc

SEQ ID NO: 215812 - DNA, 519 bp, Homo sapiens
  misc_feature: GYAE6OF02I2UMG.1.34.D01.1.454.CMB.1.raw
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctatggtgcatccagattgcgaaggtgggtcccatccaggttcagtggcagtgcagtcgtgggacagtattacgactctcactatcagcacgcctgcagcctagaagtnttttagacttaatttattacgttgtactaactagttaattaacttacgtacccttaggtcgtacgttcggccgacgggtacgtaaggtaggaacgtacgaacgtacgtgtggcgtgacc

SEQ ID NO: 215813 - DNA, 394 bp, Homo sapiens
  misc_feature: GYAE6OF02GYLS2.1.34.D01.1.454.CMB.1.raw
  modified_base (387)..(394): a, c, t, g, unknown or other
  misc_feature (387)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgccctcctcacgcactcgtctgacgcgggctgggcaaggcgcatagnnnnnnnn

SEQ ID NO: 215814 - DNA, 522 bp, Homo sapiens
  misc_feature: GYAE6OF02JHEOD.1.34.D01.1.454.CMB.1.raw
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatgggtgcatccagattgcaaggtgggtcccatccaggttcagtggcagtgcatcgtgggacagattacactctcactatcagcagcctgcagcctgagtatttgctaatttnttactgtacaatagttaattatacgtaccctagtcgggtacgttccggaccgtacggggtaacctaaggggtacggaacggtaccgaaaccggtaacgtggtacggtcgttggaccc

SEQ ID NO: 215815 - DNA, 482 bp, Homo sapiens
  misc_feature: GYAE6OF02GML2M.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggtcccatccaggttcagtggcagtgcatctgggacagattacactctcactatcagcagcctgcagcctgaagtattttgctaatttacttactgtacaactagttattatactaccctagtgacgttcggcagggaccaaggtgaagtcaacggatgtgctgac

SEQ ID NO: 215816 - DNA, 498 bp, Homo sapiens
  misc_feature: GYAE6OF02IDL09.1.34.D01.1.454.CMB.1.raw
  modified_base (280)..(280): a, c, t, g, unknown or other
  misc_feature (280)..(280): n is a, c, g, or t
  modified_base (440)..(440): a, c, t, g, unknown or other
  misc_feature (440)..(440): n is a, c, g, or t
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctnagatcgtagtctatggtgcatccagattgacgaagggtcgggtcccatccgaggttcaggtggcagtgctatcgtagggacagtattacactctacactatcagcagcctgcagcctagaagtattttgactaatttattactgtacaactagttattanacgtaccctagtcggtacgttcggcgagggacaaggtagagtcaacgatggngctgac

SEQ ID NO: 215817 - DNA, 500 bp, Homo sapiens
  misc_feature: GYAE6OF02IJQS0.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaattttattactgtacaactagttattatacgttacccctagtcggacgttcggacctaggggaccaagggtcgaagtcaaccggatggtggctgacc

SEQ ID NO: 215818 - DNA, 509 bp, Homo sapiens
  misc_feature: GYAE6OF02HYYU4.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctatggtgcatccagattgcaaggtgggtcccatccaggttcagtggcagtgcatcgtgggacagacttacactctcactatcagcagcctgcagcctagaacgtattttgactaatttatactgtcaactagttaattatacgtaccccgtagtacggacgttcggaccgtaaggggacaaggtcggaagtccgaaaccggtactggtacggtctgacc

SEQ ID NO: 215819 - DNA, 553 bp, Homo sapiens
  misc_feature: GYAE6OF02GTF6B.1.34.D01.1.454.CMB.1.raw
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (526)..(553): a, c, t, g, unknown or other
  misc_feature (526)..(553): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggtttcagtgcagtgcatcgtggacagtattacactctcactatcagcacgcctgcacgtcctagaagttattttcgacttaattttattactgtaccaactagttattagtaaccgtacccccgtaggtacgggtacgttccggaccggaacgggggacctaagggtaggaacgtaccgaaacccggaacgttggtcggtcgtcggaccaaccgtattcgttacgttcctttactatttccccgttccccgacctactttccgtacggaacccgtacctaaccgttccgtaccgttagggaccgggccggggtccttacggggaacccgtaacgggggccgtaacctaaggttacggncgncnnnnnnnnnnnnnnnnnnnnnnnnnnnn

SEQ ID NO: 215820 - DNA, 500 bp, Homo sapiens
  misc_feature: GYAE6OF02I06O8.1.34.D01.1.454.CMB.1.raw
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
  modified_base (494)..(494): a, c, t, g, unknown or other
  misc_feature (494)..(494): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctatggtgcatccagattgcgtaaggtcgggtcccagtccaggttcagtggcagtgcagtcgtgggacagtattacactctacactatcacgcagcctgcagccctagaagtnttttagacttaatttacttactgttacaactagttaactatacgtaccctagtcgacgttcggcgagggaccaggtagaagtcaaccgatgngctgac

SEQ ID NO: 215821 - DNA, 548 bp, Homo sapiens
  misc_feature: GYAE6OF02ITSG2.1.34.D01.1.454.CMB.1.raw
  modified_base (197)..(197): a, c, t, g, unknown or other
  misc_feature (197)..(197): n is a, c, g, or t
  modified_base (381)..(381): a, c, t, g, unknown or other
  misc_feature (381)..(381): n is a, c, g, or t
tcagacgagtgcgtcacgaccggtgctcgatttagatcgtctgtgttgggtttgggcgagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcgagtcaggccatcagcgattctttagcctggttgcagcagaaaccagggcgacgcccctcagatcgtagtctatggtgcatccagattgcgaaggtggggtcccatccgaggttcaggtggcagtgcatcgtgggacagtacttacactctacactancgagccagcctgcacgcctagtaatattttgacttaatttacttacgtagtaccaagttaagttactttaacgtaccgttacccgtacggtacggttaccggttccggaccggaacgggtaaccgtaagggtaggaacgtacgaaccggtaactggtacgtcgtacg

SEQ ID NO: 215822 - DNA, 524 bp, Homo sapiens
  misc_feature: GYAE6OF02G0ZIL.1.34.D01.1.454.CMB.1.raw
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagccccctcagatcgtagtctagtggtgcatccagattgcaagggtcgggtcccagtccaggttcaggtggcagtgcatcgtgggacaggtattacactctcactatcagcagcctgcagcctgaagtnttttgactaattttatactgtactaactagttaattataacgtacccctacgtggtaccgttcggaccgtaggggtaccaagggtcggaagtaccgaaccggtacttggtacggctagaccg

SEQ ID NO: 215823 - DNA, 431 bp, Homo sapiens
  misc_feature: GYAE6OF02G86WH.1.34.D01.1.454.CMB.1.raw
  modified_base (396)..(397): a, c, t, g, unknown or other
  misc_feature (396)..(397): n is a, c, g, or t
  modified_base (399)..(431): a, c, t, g, unknown or other
  misc_feature (399)..(431): n is a, c, g, or t
tcagacgagtgcgtcacgaccggtgctcgatttagatcgtctgtggttgggtttggggagtcaggccatcagcgattctttagcctggttgccagcagaaaccagggcgagccccctcagatcgtagtctatggtgcatccagattgctaaggtggggtcccatccaggttcagtggcagtgcatctgggacagattacactctcactatcagcagcctgcagcctgaagattttgctaatttattactagtcaaccagtattactagtaccccctacgtggacgtttcggccaggggaccaaggtgaacgtcaaccgaactgtggctgcaccgatctgtcttcatcttcccgccatctgaacgcactcgtctgagcggctggcaaggcgcatagnntnnnnnnnnnnnnnnnnnnnnnnnnnnnnnnnnn

SEQ ID NO: 215824 - DNA, 484 bp, Homo sapiens
  misc_feature: GYAE6OF02JHJ5I.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatctgggacagattacactcgtcactatcagcacgcctgcagcctgaatatttgactaatttatactgtacaatagtattatacgtaccctagtgacgtcggcagggaccaaggtgaagtccaacgactgtcggctgacc

SEQ ID NO: 215825 - DNA, 607 bp, Homo sapiens
  misc_feature: GYAE6OF02GS0NR.1.34.D01.1.454.CMB.1.raw
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
  modified_base (602)..(602): a, c, t, g, unknown or other
  misc_feature (602)..(602): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtacccagccgtgacactccaacttagtacccgaaccgtcttcctactaccttcccctccgttcgtcgtcactacttacttaggtaggaacacgaggtcaccaactctaccttacgtccggggccgggacgtacgtacggaccgactcacgacggactttctttacgtaccgtcggtttggtcagcacgaaaccgaacgggcggacgacccctccagaatcgtacgtacttactggtggtcataccacgaagttgcgaagggtacggggggttcccgactaccgtacggttcgaacgtggcgagtgcatcgtgggacagattactacgtctcatactncgacacgctcgnacgctgaagtntttcganaatttattactgtacaactagttattatacgtacccctagtcgtacgttccggcgacggggaacgtacggtaggaataccaacgacgtgtggctacnaaccg

SEQ ID NO: 215826 - DNA, 509 bp, Homo sapiens
  misc_feature: GYAE6OF02JE3GT.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtatttgactaatttattactgtacaactagttattactaacgtacccttagtggtacgttcggaccgagggacctaaggtacggtaagtacgaaccgaacgtggtcggtcgtgacccg

SEQ ID NO: 215827 - DNA, 539 bp, Homo sapiens
  misc_feature: GYAE6OF02HVQBU.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctnagatcgtagtctatggtgcatccagattgcaaggtcgggcccatccaggttcagtggcagtgcatcgtgggacagtattacactctacactatcagcagcctgcagcctagaagtattttgacttaaattttatactgtacaactagtttaacttactacgtaccctagttacggtacgttccgggaccgtaaggggaacccgtaagggttacggaacgttaccaaacccggtaacgttggtacggtactacggaccc

SEQ ID NO: 215828 - DNA, 494 bp, Homo sapiens
  misc_feature: GYAE6OF02GJZNI.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaagggtgggtcccatccaggttcagtggcagtgcatctgggacagattacactctcactatcagcagcctgcagcctgaagtatttgactaatttattactgtacaatagtattatacgttaccctagtggtacgttcggacgagggaccaaggtggaacgtcaacgactggtggctgccaccatctgtccttacacttcctcccgacc

SEQ ID NO: 215829 - DNA, 593 bp, Homo sapiens
  misc_feature: GYAE6OF02HZTVR.1.34.D01.1.454.CMB.1.raw
  modified_base (261)..(261): a, c, t, g, unknown or other
  misc_feature (261)..(261): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtggttgggtttgggggagtcagaccctgtcaggacacagcatggacatgagggtccccgctcagctcctggggctcctgctgctctggctcccaggtaccagctggttgacatccaatttgacccagtcctccatcctccctgtctgcatctattggaggacagagtcaccatcacttgccgggcagtcaggccatcagcgattctttagcctggttncagcagaaaccagggcgacgcccctgagatcggtagtctaagtggtagcatccgaggtactttcgaagggttcggggtaccctagttccgtagggttacaaggtaggactaaggtgactagtcggtaggggactaaggtactttaacnctactactactatcagcagtccctagcagtcctagaagttatttgacttaaatttattaactgtacaatagtaacttacgtacgtaaccctaggtacggtaccgttacggaccggtaaggggtaacctaagggtacggaacgtaccgaaccggtaacgttgggtacggtactacggacctaacg

SEQ ID NO: 215830 - DNA, 487 bp, Homo sapiens
  misc_feature: GYAE6OF02FXFV2.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtagcatccagattgcaaggtgggtcccagtccaggttcagtggcagtgcatcgtgggacagattacactctcactatcagcagcctgcagcctgaagnttttgactaatttatactgtacaactagtattatacgtaccctagtgacgttcggcagggaccaaggtgaagtcgaacgtagtgtggctgacc

SEQ ID NO: 215831 - DNA, 578 bp, Homo sapiens
  misc_feature: GYAE6OF02I2R0S.1.34.D01.1.454.CMB.1.raw
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattctttagcctggttgcagcagaaaccgagggccgacgcccctcagactcgtagttcatggtncatccagattgcgaaggtcgggtccatcgagttcagtggcagtgcagtcgtgggacagattaacacgtctacatatcagcacgcctggcctagaccctagtaaacggttatttttcggaacttaaacgtttttaacttaccgtacggttacctaaacgtaacgtttaatttaactaacccggttaaccccgttaggttacggaaccgtttccgggacgtaaccgggacgtaaacgggtggaacgttacgaaccgtaagttggtacgggtcagtaccg

SEQ ID NO: 215832 - DNA, 549 bp, Homo sapiens
  misc_feature: GYAE6OF02JFX1D.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatctgggacagattacactcactactactacacgcgacgcctagacgacgtccgtagaacgttagtttcgaacttaacttttactacgttacgtaacaacgttagttaattaactaccgttaacccgtaggtacgtacgttccggtacggaacggtaaccggtaaggtaggacgtaaccgaaccggtaacgtggacgtcgagtacc

SEQ ID NO: 215833 - DNA, 581 bp, Homo sapiens
  misc_feature: GYAE6OF02HCTFI.1.34.D01.1.454.CMB.1.raw
  modified_base (280)..(280): a, c, t, g, unknown or other
  misc_feature (280)..(280): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaaggtgggtcccatccaggttcagtggcagtgacatcgtgggacagtacttacactctcactatcagcagcctgcagctagaagttntttagacttaatttactttacgtcgttaactaaacgtagtttaaacttacgttaaaccgttaccccgttaacggtcgggttaaccggtttccgggaaccggtaacgggggtaacctaaaggggtaccggtaaacggttaccgtaaacccggtaacggttacggtacgggtacctacggtacccg

SEQ ID NO: 215834 - DNA, 505 bp, Homo sapiens
  misc_feature: GYAE6OF02GQTQ6.1.34.D01.1.454.CMB.1.raw
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctatggtgcatccagattgcgaaggtgggtcccatccaggttcagtggcagtgcatcgtgggacagattacactctcactatcagcagcctgcagcctagaagtnttttgacttaatttattactgtacaactagtaattatacgtacccgtagtacggtacgttcggcaaggggacctaaggtggaactacgaaccgagtggtacggctgacc

SEQ ID NO: 215835 - DNA, 505 bp, Homo sapiens
  misc_feature: GYAE6OF02GI2KD.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctatggtgcatccagattgcgaaggtgggtcccatccaggttcagtggcagtgcatctgggacagattacactctcactatcagcagcctgcagcctgaagtattttgcttaatttattactgtacaactagttaattatacgtaccctagtacggtacgttcggccgtaaggggacctaagggtcggaagtccaaccgacgtggtcggctgaccg

SEQ ID NO: 215836 - DNA, 529 bp, Homo sapiens
  misc_feature: GYAE6OF02IDM3D.1.34.D01.1.454.CMB.1.raw
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagctgaaaccagggcgagcccctcagatcgtagtctatggtgcatccagattgcaaggtgggtcccatccaggttcagtggcagtgctatcgtgggacagtacttacacttctcactatcagcagcctgcagtcctagaagttntttgacttaatttacttactagtacaatagttaattaacgtacgttacccgtagtacggtacggttccggaccggacggggaccgaagggtaggaacgtacgaaccgtacgtaggcggtacgtgaccg

SEQ ID NO: 215837 - DNA, 481 bp, Homo sapiens
  misc_feature: GYAE6OF02HKGWK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtaccctagtgacgttcggccagggaccaaggtggaagtcaacgaactgtggctgac

SEQ ID NO: 215838 - DNA, 532 bp, Homo sapiens
  misc_feature: GYAE6OF02FMZYR.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgacaaggtcgggtcccagtccaggttcagtggcagtgcatctgggacagacttacactctcactatcagcagcctgcacgcctagaagtattttcgacttaaatttattactagttacaacttagttatttaataccgttaacccgttacggtcggtaccgttcggaccgagggtaaccgaagggtacggaagtacgaaccgtacgtggtacgtcgtgaccg

SEQ ID NO: 215839 - DNA, 538 bp, Homo sapiens
  misc_feature: GYAE6OF02I8UPJ.1.34.D01.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctattggagacagagtcaccatcacttcggccgggcgagtcaggccatcagcgtattcttagcctggttgcagcaagaaaccagggcgacgcccctnagatcgtagtctagtggtgcatccagtattgacgaagggtcgggtacccatccgaggtttcaggtcggcagtgctatcgtgggacagtacttacactctcactatcagcacgcctgcagcctagaagttatttgaacttaatttacttactgtactaactaagttacttaatacgtaccctaggtcgtacgttcggccggtaagggacgtaagggtacgaacgtaccgaaccgtacgtggtcggactgaacc

SEQ ID NO: 215840 - DNA, 501 bp, Homo sapiens
  misc_feature: GYAE6OF02FS90H.1.34.D01.1.454.CMB.1.raw
  modified_base (222)..(222): a, c, t, g, unknown or other
  misc_feature (222)..(222): n is a, c, g, or t
  modified_base (376)..(376): a, c, t, g, unknown or other
  misc_feature (376)..(376): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcacctatcacttgccgggnagtcaggccatcagcgattctttaagcctggttgcagcagaaaccagggcagcccctcagactcgtaggtctatggtgcatccagattgcgaaggtgggtacccagtccaggttcagtggcagtgcatcgtgggacagattacactctcactancagcagcctgcagcctgaagtatttgactaatttattactgtacaactagttatatacgtacccgtagtggtacgttcggccgagggacctaaggtagaagtacaaccgtaactgtggtctgacc

SEQ ID NO: 215841 - DNA, 488 bp, Homo sapiens
  misc_feature: GYAE6OF02F7345.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactatattatacgtaccctacgtgacgttcggccagggaccaaggtgaagtacgaaccgactgtcggctgac

SEQ ID NO: 215842 - DNA, 512 bp, Homo sapiens
  misc_feature: GYAE6OF02I8YPK.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctcagatcgtagtctatggtgcatccagattgcaaggtgggtcccatccaggttcagtggcagtgcatctgggacagattacactctcactatcagcagcctgcacgcctgaacgtattttgactaatttattactgtccaactagttattactacgttacccctagtacggtaccgttcggaccgtaggggacctaagggtacggaagtcgaaccggaactggtcggtcgtgaccg

SEQ ID NO: 215843 - DNA, 383 bp, Homo sapiens
  misc_feature: GYAE6OF02GOQE3.1.34.D01.1.454.CMB.1.raw
  modified_base (373)..(373): a, c, t, g, unknown or other
  misc_feature (373)..(373): n is a, c, g, or t
  modified_base (378)..(383): a, c, t, g, unknown or other
  misc_feature (378)..(383): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcgccaggggaccaaggtgaagtcaacgaactgtggctgcaccatctgtcttcatcttcccacctctcacgcactcgtctgagcgggctggcaaggcnatagnnnnnn

SEQ ID NO: 215844 - DNA, 491 bp, Homo sapiens
  misc_feature: GYAE6OF02IEN3V.1.34.D01.1.454.CMB.1.raw
  modified_base (282)..(282): a, c, t, g, unknown or other
  misc_feature (282)..(282): n is a, c, g, or t
  modified_base (488)..(488): a, c, t, g, unknown or other
  misc_feature (488)..(488): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaagggtcgggtcccatccaggttcaggtggcagtgcatcgtgggacagattacactctacactatcagcagcctgcagcctagaagtattttgactaatttattactgtacaactagttatatacgtaccctagtgtacgttcggccgagggacaggtagaagtcaacgatgtgcngac

SEQ ID NO: 215845 - DNA, 480 bp, Homo sapiens
  misc_feature: GYAE6OF02I5S0K.1.34.D01.1.454.CMB.1.raw
  modified_base (477)..(477): a, c, t, g, unknown or other
  misc_feature (477)..(477): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctcagatcgtagctatggtgcatccagattgcaaggtgggtcccagtccaggttcagtggcagtgcatctgggacagattacactctcactatcagcagcctgcagcctgaagtattttgactaatttatactgtacaatagttatatactaccctagtcggacgttcggccagggaccaaggtgaagtcaacgactgtgcngac

SEQ ID NO: 215846 - DNA, 493 bp, Homo sapiens
  misc_feature: GYAE6OF02GFBG6.1.34.D01.1.454.CMB.1.raw
  modified_base (467)..(467): a, c, t, g, unknown or other
  misc_feature (467)..(467): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcatcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtatttgctaatttattactgtacaactagtattatacgttacccctagtcggacgttcggccgaggggaccaaggtgaagtcacgtactgtggctgcacnttctcgtcttcactccttccctaccc

SEQ ID NO: 215847 - DNA, 475 bp, Homo sapiens
  misc_feature: GYAE6OF02IXP4I.1.34.D01.1.454.CMB.1.raw
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctatggtgcatccagattgcaaggtgggtcccatccaggttcagtggcagtgcatcgtgggacagattacactctcactatcagcagcctgcagcctagaagtatttgactaatttattactgtacaactagtatatacgtaccctagtgacgttcggcgagggacaaggtgaagtcacgatgngcngcacntctgtctnctctccncc

SEQ ID NO: 215848 - DNA, 792 bp, Homo sapiens
  misc_feature: GYAE6OF02FUG4Q.1.34.D01.1.454.CMB.1.raw
tcagacgagtgcgtcacgaccggtgctcgatttagatcgtctgtgttgggtttgggggagtcagaccatgtcaggacacagcatggacatgagggtccccgctcagctcctggggctcctgctgctctggctcccaggtaccagctgtgacatccaattgacccagtctccacctccctcgtctcgtcactctacttaggtaggacacgagtctaccactactaccttacgtccgggccggacgtacgtacggaccgactactacgacgacgttacttttacgttccgtcggtttggtcacgtacgacgaaaaccgaacgggacgggacgccccgtccctaggacgtacgttacggtacgtattaggtgggcacttacctacggtaagttagtaccgaaagggtacgggggttccccggacctaccgtaccggtttacggtaccgtaggggtccgacgtaggtcgaacgtcgttcggggaacggaacgtacgttaacctaacctccttacctactaacttacacggtaccaacgccgttcgacgacgtcccgttaggttaacgtaatttttcggttacctaaactttttaaacgttttactttaccgttaacggtaaaccttaacgggtttaaagtttaactttaaccggttaacccccgtttaacccggttaggggttacccgggtttaccggttccccggaaacgggggtaacccggtaaacgggttacgggtaaacggttaacccgaacccgggttaaaccgtacggtttcgggaccttacggtacccg

SEQ ID NO: 215849 - DNA, 524 bp, Homo sapiens
  misc_feature: GYAE6OF02G3301.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgcatcgtgggacagtattacactctacactatcgagcagcctgcagctagatatttgacttaatttattactgtactaactagttaattactacgttaccctagtacggtacgttacgggccgtaagggaccgtaagggtacggaagtaccgaaccggtaacgttaggtcggtctagtacccg

SEQ ID NO: 215850 - DNA, 661 bp, Homo sapiens
  misc_feature: GYAE6OF02G0ORU.1.34.D01.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttggccgggnagtcaggccatcagcgtattcttagcctggttgcagacaagaaaccgagggccgacgcccctanagactcgtaagtctagtggtgacatccgagtagttgacgtaagggtcgggtaccctagtccgtaaggtttcgaaggtggactaaggtcgacgtagttcggtaggggaactaaggtacttaaccacttacctacgtaacttatccgaaggcacggcctgactacgccttaggaaacgttattttacgaacttaattttaacttacgtagttaacaaacgttagttaacttaacgttaacccgttaccccgtaaggttacggtaaccgggtttaccgggaaccgggtaaccggggtaacccgtaaaggggttaacgggtaaaccgttacccggtaaaaccggtaacggttacgggttacggtaccgtacgtaacccg

SEQ ID NO: 215851 - DNA, 564 bp, Homo sapiens
  misc_feature: GYAE6OF02HT2WS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctcagatcgtagtctatggtgcatccagattgcgaagggtcgggtcccatccaggttcaggtggcagtgcatcgtagggacagattaacacttctcactatcagcagcctgcagcctagaagtattttgacttaaagtttattacgtgtactaactagttaattaacgtaacgttaacccctaggttacggaccgtttacgggacccgtaacgggggtaccctaaagggttacgggaaacgttaccgaaaccggtaacgttacgggttacggtccgtaggtacccg

SEQ ID NO: 215852 - DNA, 512 bp, Homo sapiens
  misc_feature: GYAE6OF02FZHWV.1.34.D01.1.454.CMB.1.raw
  modified_base (284)..(284): a, c, t, g, unknown or other
  misc_feature (284)..(284): n is a, c, g, or t
  modified_base (383)..(383): a, c, t, g, unknown or other
  misc_feature (383)..(383): n is a, c, g, or t
tcagacgagtgcgtcacgaccggtgctcgatttagatcgtctgtgttgggtttgggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccgaggggcgacgccccctnagatcgtagtctagtggtgcatccagtattgacgaagggtcgggtcccatccgaggttcaggtggcagtgcatcgtgggacagattacactctcactancagcagcctgcagcctagaagtattttgacttaatttattactgtacaatagttattatacgtaccctagtcgtacgttcggcgagggtaccaaggtcggaagtacgaaccgtacgtggtcggctgacc

SEQ ID NO: 215853 - DNA, 390 bp, Homo sapiens
  misc_feature: GYAE6OF02GRFSE.1.34.D01.1.454.CMB.1.raw
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacncactcgtctgagcgggctggcaaggcgnatagnnnnnnnn

SEQ ID NO: 215854 - DNA, 522 bp, Homo sapiens
  misc_feature: GYAE6OF02GSE71.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggtcccatccaggttcagtggcagtgcatctgggacagattacactctacactatcagcacgcctgcagcctagaagtattttgacttaatttattactgtacaactagttaattaactaacgttacccctaggttacggaccgtttcggaccgacggggtaccaagggtcggaagtaccaaccggtacgttggtacggtctgacc

SEQ ID NO: 215855 - DNA, 670 bp, Homo sapiens
  misc_feature: GYAE6OF02JXR8A.1.34.D01.1.454.CMB.1.raw
  modified_base (196)..(196): a, c, t, g, unknown or other
  misc_feature (196)..(196): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatgganacagatcaccatcacttgccgggcagtcaggccatcagcgattcttagcctggttgcagcaagaaaccngggcacgcccctnagtatcgtagtctatgggtncatccagtattgacgtaagggtcgggtacccagtccgaggttcaggtggccaggtcgactagtcggtagggactaggtaacttaccacttccgtactaacttagtcacggacaacgtccgttacggacctacggtacccgtaggtaaacgttattttttacggaacctttaaaattttttacgttaccttacggtaacctaaaacgttaacggtttaattttaaacggtaaacccggtttaacccccgttaacgggttacgggttaacccggtttacccgggaaccgggtaaacggggtaaccgtaaaggggttcggtaaaccggttaaccgtaacccggaaacgtttgggtacggtaccgtacgtaacccg

SEQ ID NO: 215856 - DNA, 621 bp, Homo sapiens
  misc_feature: GYAE6OF02IYXXP.1.34.D01.1.454.CMB.1.raw
  modified_base (444)..(444): a, c, t, g, unknown or other
  misc_feature (444)..(444): n is a, c, g, or t
  modified_base (487)..(487): a, c, t, g, unknown or other
  misc_feature (487)..(487): n is a, c, g, or t
tcagacgagtgcgtcacgaccggtgctcgatttagatcgtctgtgttgggtttgggggagtcagaccctgtcaggacacagcatggacatgagggtccccgctcagctcccgtgggctcctgctgctcgtggcctcccgaggtaccagctgtgacatccaattcgacccagtcctccactccctccctgtctgcatctagttggagacagagtccaccatcacttcggccgggcgagtcgaggccatcagcgtatttcttacgccgttgggttcgcgtacgacaacggaaacccgaggggaccgaccgccccctacgagacgtcggtagtctagtggtgactactccagtattgacgtaaggggtcgggtacccagtccgtaggttcaggtggctagtcgctagtcggtagggactagtaactttaccacttccgtctaacttntaccgacgtcacgcccgttgaccacgtcccgtaagtaacgttnttttcgattaattttacttacgtgtacaagttagttaattactaaccgttaccctaggtcgtacgttccggacggtacgggaaccgtagggtacggacgtaacccgaacggtacgttggcggtactcgtacccg

SEQ ID NO: 215857 - DNA, 515 bp, Homo sapiens
  misc_feature: GYAE6OF02IJUQY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtgcagtgcatctgggacagattacactctcactatcagcagcctgcagcctagaagtattttcgactaattttattactagtactaactagttattatacgtaccctaggtcggtacgttcggacgtacggggtaccaagggtcggaacgtcgaaccggtaacgtcggtacggcctgaccg

SEQ ID NO: 215858 - DNA, 532 bp, Homo sapiens
  misc_feature: GYAE6OF02GPWZW.1.34.D01.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgacgcccctnagatcgtagtctatggtgcatccagattgcaagggtgggtcccatccaggttcagtggcagtgcatcgtgggacagattacactctacactatcagcacgcctgcagcctagaagtatttgactaatttattactgtacaactagttaacttactaacgttaccctaggtcggtaccggttcggaccgtacggggaccgtaagggttacggtaagtaccgaaccggtaacgttggtacggtacctgtaccg

SEQ ID NO: 215859 - DNA, 508 bp, Homo sapiens
  misc_feature: GYAE6OF02FTC1G.1.34.D01.1.454.CMB.1.raw
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcgagcccctcagatcgtagtctatggtgcatccagtattgacgaaggtcgggtcccagtccgaggttcaggtggcagtgcagtcgtgggacagattacactctcactancagcacgcctgcacgcctagaagtnttttcgacttaatttatactgtacaactagttattactacgtaccctaggtcgacgtcggccgagggaccaagggtgaagtcaacgtactggtcggctgacc

SEQ ID NO: 215860 - DNA, 521 bp, Homo sapiens
  misc_feature: GYAE6OF02IQ0GO.1.34.D01.1.454.CMB.1.raw
  modified_base (365)..(365): a, c, t, g, unknown or other
  misc_feature (365)..(365): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctacagatcgtagtctatggtgcatccagattgcaaggtcgggtcccatccaggttcagtggcagtgcatcgtgggacagattacnctctcactatcagtcagcctgcagctagaactattttcgactaattttattacctgactaaactattaattataacgtacccgtagtacggtacgttcggaccaacggggtacaagggttaggaagtacgaacccgtaatacggtggtctaggacc

SEQ ID NO: 215861 - DNA, 587 bp, Homo sapiens
  misc_feature: GYAE6OF02IACZX.1.34.D01.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccggcagtcaggccatcagcgattnttagctggttncagcagaaccngggcagcccctnagatcgtagtctatggtgcatccagattggcaagggtcgggtcccagtccgaggttcaggtggcngtncatcgagggacagtattacactctcactatcacgcagtcctgacagtcctaggtaaagttattttacggactttaaagttttacgttactagttactaacgttaagttactttaacgtaaccgttaaccccgtaggttacgggtacccggtttaccgggacccggtaacgggggtacccgtaaaggggttacggaaccggttaccgaaacccggtaacgttcggtacgggtacctcggtaacccg

SEQ ID NO: 215862 - DNA, 607 bp, Homo sapiens
  misc_feature: GYAE6OF02JL261.1.34.D01.1.454.CMB.1.raw
  modified_base (251)..(252): a, c, t, g, unknown or other
  misc_feature (251)..(252): n is a, c, g, or t
  modified_base (254)..(254): a, c, t, g, unknown or other
  misc_feature (254)..(254): n is a, c, g, or t
  modified_base (544)..(545): a, c, t, g, unknown or other
  misc_feature (544)..(545): n is a, c, g, or t
tcagacgagtgcgtcacgaccggtgctcgatttagatcgtctgtgttgggtttgggcatggacatgagggtcccgctcagctcctgggctcctgctgctctggctcccacggtaccagctgtgacatccaattgaccacgtctccactcctccctgtctgcatctattggagacagagtcaccactcacttcggccgggcgagtcacgccactacacgacgtacttactttacgtccgtcggttcgacganncncgaaccaacggaacggacggccgtaccgaccgacgtacgtacgttacgttacgttacgttagtcgtacgtacctacgtacgtagtacgtaacggtacgggtaccgggtaccggtaccgtacgttaccgtacggttacggtacgtacggtacgtacgtacgtacgtacggtacggtacggacgtaacgtacttacctactactactactacgacgacgacgtacgacgtacgacgtacgtacgtagttagtacttaacgttaacttaacttacttactactaacgtaattnnactacacgtaaccgtacgtaccgtacgtacgacggacggacgaggacgacgtacgacgtacg

SEQ ID NO: 215863 - DNA, 554 bp, Homo sapiens
  misc_feature: GYAE6OF02HNHYU.1.34.D01.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttncagcagaaaccagggcgagcccctnagatcgtagtctatggtgcatccagattgcaagggtcgggtcccatccgaggttcaggtggcagtgcatcgtgggacagtattacgactctcactatcagcagcctgcagcctagaagtatttgacttaatttattactgtacaactagttattacgtacgtaccctagtcggtacgttcggaccgtacggggacctaagggtcggaacgtccgaaccgtaacgttcggtcggcctacggtacctaaccgtagttccgttacgttacctttaccgacgtttccccttacccctaaccccg

SEQ ID NO: 215864 - DNA, 701 bp, Homo sapiens
  misc_feature: GYAE6OF02IM5Z3.1.34.D01.1.454.CMB.1.raw
  modified_base (494)..(494): a, c, t, g, unknown or other
  misc_feature (494)..(494): n is a, c, g, or t
tcagacgagtgcgtcacgaccggtgctcgatttagatcgtctgtgttgggggtttcgggacaactggacactcgagggtccccgactcccagctcctgggggacctcccctcgctggcctcgtcggcgtcccgaggttacccagttcgtggtgacatccaacttcgacccagtcctccactccgtccctgtctgcatctattgggagtacaggagtacaaccactcggaccttggccggggtcgaaggttccagggcccaagtccagcgtatttccttacgcctggttgctagctagaaaccagggtcgagcccctcacggaccgtacgtaagtccttagtggtgctagtccaggattcgacgaaggtcggggtcccaagtccgtaacggttacaaaggttcggacctaaggtacggtaccgaacgtcgtaggggaactacgtaacttacgacgtactactactactcgagctacgtctgcgacgctagaagtnttagactattatctacgacaacgtagttatacgttacgtaaccctttaggtcggtaccgttaccggaccgtaacggggtacccgtaaagggttacgtaacgttaccgtaaccggtaacgttcggtaacggttccgtacggtacccgtaaccggttacgttaccggttaccgttcgtttacccgaacgtttcccgtaccccgtacccg

SEQ ID NO: 215865 - DNA, 394 bp, Homo sapiens
  misc_feature: GYAE6OF02GXSS5.1.34.D01.1.454.CMB.1.raw
  modified_base (381)..(381): a, c, t, g, unknown or other
  misc_feature (381)..(381): n is a, c, g, or t
  modified_base (387)..(394): a, c, t, g, unknown or other
  misc_feature (387)..(394): n is a, c, g, or t
tcagacgagtgcgtcacgaccggtgctcgatttagatcgtctgtgttgggtttgggagtcaggccatcagcgattctttagcctggttgtagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatagtaccccctagtggacgttcggccaggggaccaaggtggaagtcaaccgaactgtggctgcaccatctgtcttcatctcccgcatctgaacgcactcgtctgagcgggctgggcaagggcncatagnnnnnnnn

SEQ ID NO: 215866 - DNA, 684 bp, Homo sapiens
  misc_feature: GYAE6OF02IZOIA.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagatcaccatcacttgccgggcagtcaggccatcagcgtattcttagcctggttgcagcaagaaaccgaggggcgacgcccctcaggatcgtagtctagtggtgcactccagtattcgacgtaaggggtcgggtcccagtacccgaggttcaggtggctaggtgactagtcgtgggaactaggtaacttaacgtaccttctactaacgttataccgaagtccgaacggtccctagaccgacgtcccgttaaggtaaacgtttacttttttacggaacctttaaaattttttaacgtttaaccgttggttaacctaaaacgttaagttttaaactttaacgtttaaaccggttacccccgtttaacgggttcgggttaaccggtttacccgggacccgggtaaaggggggtaacccgtaaaggggttacgggtaaacgttacccggtaaacccggtaacgttcgggtacgggtcctacggtacccg

SEQ ID NO: 215867 - DNA, 479 bp, Homo sapiens
  misc_feature: GYAE6OF02HI5SN.1.34.D01.1.454.CMB.1.raw
  modified_base (478)..(478): a, c, t, g, unknown or other
  misc_feature (478)..(478): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtatttgactaatttattactgtcaacagttattatacgtacccctagtcggtacgttcggccaggggaccaggtgaagtcacgatgtggctgcacatctgtctcatcctccnc

SEQ ID NO: 215868 - DNA, 554 bp, Homo sapiens
  misc_feature: GYAE6OF02IL0L7.1.34.D01.1.454.CMB.1.raw
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (351)..(351): a, c, t, g, unknown or other
  misc_feature (351)..(351): n is a, c, g, or t
  modified_base (427)..(427): a, c, t, g, unknown or other
  misc_feature (427)..(427): n is a, c, g, or t
  modified_base (478)..(478): a, c, t, g, unknown or other
  misc_feature (478)..(478): n is a, c, g, or t
  modified_base (548)..(548): a, c, t, g, unknown or other
  misc_feature (548)..(548): n is a, c, g, or t
tcagacgagtgcgtcacgaccggtgctcgatttagatcgtctgtgttgggtttgggggtagtcagaccctgtcaggacacagcatggacatgagggtccccgctcagctcctgggctcctgctgctctggctcccaggtaccagctgtgacatccaattgacccagtctccatcctcctgtctgcatctattggagacagagtcacatcacttgccgggcagtcaggcatcagcattcttagcctggttncagcagaacaggcgacgcccctanagatccgtagtctagtggtcgcaagttccagatttgacgtaagggtcggtacccatccgtaggttcaggtggctagngctagtcgtgggacagtattacacgtctacacttatcgaacgctacggcctagaccgtacgcccttaggaaagttntttcggtaactaaacgttttattacctagttaccaaacgttagtactttanacgtacccctagtgtaccgttcgacggacgggtacaacgggtgaacgtccaaaccggtatgggtactcgntaaccg

SEQ ID NO: 215869 - DNA, 519 bp, Homo sapiens
  misc_feature: GYAE6OF02F0ZT0.1.34.D01.1.454.CMB.1.raw
  modified_base (222)..(222): a, c, t, g, unknown or other
  misc_feature (222)..(222): n is a, c, g, or t
  modified_base (365)..(365): a, c, t, g, unknown or other
  misc_feature (365)..(365): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattctttagcctggttgcagcagaaaccaggggcgagcccctcagatcgtagtctatggtgcatccagattgcaagggtgggtcccatccgaggttcaggtggcagtgcatcgtgggacagattacnctctcactatcagcacgcctgcagcctagaatattttgacttaatttattactgtacaactattaattactacgtacccgtaggtagtacgttccggacgacggggtacaagggtggtaacgtaccgaacgtaacgtggtacggtcgtagaccg

SEQ ID NO: 215870 - DNA, 504 bp, Homo sapiens
  misc_feature: GYAE6OF02G1WIJ.1.34.D01.1.454.CMB.1.raw
  modified_base (358)..(358): a, c, t, g, unknown or other
  misc_feature (358)..(358): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaccagggcagcccctcagatcgtagtctatggtgcatccagattgacgtaaggtggggtacccatccgaggttcagtggcagtgcagtctgggacngacttacactctcactatcagcagcctgcagctgaagtatttgactaatttatactntacaactagttatacgttacgtacccctaggtgtacgttcggccgaaggggtaccaagggtgaacgtcaaccggactggtcgtctgacc

SEQ ID NO: 215871 - DNA, 564 bp, Homo sapiens
  misc_feature: GYAE6OF02FYSR6.1.34.D01.1.454.CMB.1.raw
  modified_base (281)..(281): a, c, t, g, unknown or other
  misc_feature (281)..(281): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctnagatcgtagtctatggtgcatccagtattgacgaagggtcgggtcccatccgaggttcaggttggctaggtgacagtcgtagggacaggtacttacgactctacactatcagccagcctgcagcctgaagttntttgacttaaagttttattacctagttaccaagtagttaacttagtaaccgttaccccttaggtcggtacggttccggaccggtaaggggaacctaaggggtacgaacgttaccgaaaccggtacgttacggtcggtacgttcgaacccg

SEQ ID NO: 215872 - DNA, 521 bp, Homo sapiens
  misc_feature: GYAE6OF02GP870.1.34.D01.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcagaaaccgagggcgagcccctnagatcgtagtctatggtgcatccagattgcaagggtcgggtcccagtccaggttcagtggcagtgcatcgtgggacagattacactctacactatcagcagtcctgcagcctagaatntttgactaatttacttactgtacaactagttaattatacgttaccctagtacgtacgttcggaccgtaacggggaccaagggtgtaacgtacgtaaccggaacgtggtacggactgtaccg

SEQ ID NO: 215873 - DNA, 514 bp, Homo sapiens
  misc_feature: GYAE6OF02G8Y5W.1.34.D01.1.454.CMB.1.raw
  modified_base (283)..(283): a, c, t, g, unknown or other
  misc_feature (283)..(283): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggggcgacgcccctnagatcgtagtctatggtgcatccagattgcaagggtcgggtcccatccgaggttcagtggcagtgcatcgtgggacagattacactctcactatcagcagcctgcngcctgaagtnttttgactaatttattactgtacaactgttaattactaacgtaccctagtcggtacgttcggccgtaagggacctaagggtagaagtccgaaccgacgttggtacggtctgaccg

SEQ ID NO: 215874 - DNA, 507 bp, Homo sapiens
  misc_feature: GYAE6OF02IHEA8.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaacgtattttgactaaatttattactgtacaatagttattatacgtaccctagtcggtacgttcggcgtaacggggacctaagggtcggaagtcgaaccgtaacgtggtcggctgtacc

SEQ ID NO: 215875 - DNA, 505 bp, Homo sapiens
  misc_feature: GYAE6OF02G5K4G.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaatattttgactaatttacttatgtactaacagttaattactaacgtaccctagtcggaccgttcggccgacggggtaccaaggtcggaagtacaacggtactggtcggctgacc

SEQ ID NO: 215876 - DNA, 483 bp, Homo sapiens
  misc_feature: GYAE6OF02JAH2P.1.34.D01.1.454.CMB.1.raw
  modified_base (279)..(279): a, c, t, g, unknown or other
  misc_feature (279)..(279): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (479)..(479): a, c, t, g, unknown or other
  misc_feature (479)..(479): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctagtggtgcatccagattgcgaaggtcgggtcccatccgaggttcagtggcagtgcatcgtgggacagattacactctcactatcagcagcctgcagctagatntttgctaatttntactgtacaatagtattatacgtaccctagtgacgttcggcgagggactaaggtgaagtacaaccgatgtcgntgac

SEQ ID NO: 215877 - DNA, 404 bp, Homo sapiens
  misc_feature: GYAE6OF02GVV0M.1.34.D01.1.454.CMB.1.raw
  modified_base (378)..(378): a, c, t, g, unknown or other
  misc_feature (378)..(378): n is a, c, g, or t
  modified_base (383)..(404): a, c, t, g, unknown or other
  misc_feature (383)..(404): n is a, c, g, or t
tcagacgagtgcgtcacgaccggtgctcgatttagatcgtctgtgttggggtttgggagtcaggccatcagcgattctttagcctggttgcagcagaaaccagggcgagcccctcagatcgtagtctatggtgcatccagattgcaaggtgggtcccatccaggttcagtggcagtgcatcgtggggacagattacactctcactatcagcagcctgcagcctgaagattttgctaatttatactgtcaacagtattatagtacccctacgtggacgttcggccaggggaccaaggtggaagtcaaccgaactgtggctgcacatctgtcttcatcttccgcatctgaacgcactcgtctgagcgggctggcaaggcnatagnnnnnnnnnnnnnnnnnnnnnn

SEQ ID NO: 215878 - DNA, 550 bp, Homo sapiens
  misc_feature: GYAE6OF02JW9CQ.1.34.D01.1.454.CMB.1.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
tcagacgagtgcgtcacgaccggtgctcgatttagatcgtctgtgttgggtttgggggtagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattcttagcctggttgcagcagaaaccagggcgacgcccctcagatcgtagtctatggtgcatccagattgctaaggtcgggtcccagtccaggttcagtggcagtgcatcgngggacagattacactctacactaatcaagcacgcctgcacgcctgaactagtttacgactaatttacttaacgtgttaacctaatagttacttaaatacgttaacccttaggttacgggtaccgtttacggcccggtaagggtaccgaagggttacggaagttacgaacccggtaagtacggtacggacggtctaccg

SEQ ID NO: 215879 - DNA, 556 bp, Homo sapiens
  misc_feature: GYAE6OF02HMUYW.1.34.D01.1.454.CMB.1.raw
  modified_base (281)..(281): a, c, t, g, unknown or other
  misc_feature (281)..(281): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcgaagggtcgggtacccagtccaggttcaggtggcagtgcatcgtgggacagattacactctacactatcagcagcctgacagcctagaagtnttttcgacttaaattttattactgtactaaactagttaattactaacgttaaccccttaggtacggtaccggtttcgggacccgtagggggtaaccctaaaggggttcggaaacgtccgaaaccgtaacgttgggtacggtctacggtacccg

SEQ ID NO: 215880 - DNA, 527 bp, Homo sapiens
  misc_feature: GYAE6OF02HSEW2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaccagggcgagcccctcagatcgtagtctatggtgcatccagattgcaaggtgggtcccatccaggttcagtggcagtgcatcgtgggacagattacactctcactatcagtcagcctgcagcctgaagtattttgacttaatttattactgtacaatagttattactacgttaccctaggttacggtacgtttcggccgtaacggggaacctaagggttacggaacggttaccgaaccggtaacgttggtacggtctaggtaccc

SEQ ID NO: 215881 - DNA, 534 bp, Homo sapiens
  misc_feature: GYAE6OF02IBXNF.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagcctggttgcagcagaaaccagggcgagcccctnagatcgtagtctatggtgcatccagattgactaagggtcgggtcccagtccaggttcaggtggcagtgcatcgtgggacagtattacactctcactatcagcagctgcagcctagaagtattttagacttaaattttattactagtaccaatagttaattaactacgttaaccctagtcggtacgttcgggccgtaaggggtaccgaagggtacggaagttaccgaaccggtacgttggtacggtacgtgtacc

SEQ ID NO: 215882 - DNA, 510 bp, Homo sapiens
  misc_feature: GYAE6OF02HM9H9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctaagatcgtagtctatggtgcatccagattgcaaggtggggtcccatccaggttcagtggcagtgcatctgggacagtattacactctcactatcagcagcctgccagcctagaagtattttgactaatttattactgtacaactagttaattatacgtacccttacgtggtacgttcggaccgaaggggaccaagggtggaagtacgaaccgaactgtaggctgcaaccg

SEQ ID NO: 215883 - DNA, 516 bp, Homo sapiens
  misc_feature: GYAE6OF02GDG7L.1.34.D01.1.454.CMB.1.raw
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcaagaaaccgngggcgacgcccctcagatcgtagtctatggtncatccagatttgcgaagggtcgggtacccagtccaggtttcaggtggcagtcgcatcgtgggacagattacactctacactatcagcacgcctgcagcctagaagttattttgacttaatttattactgtacaactagttattatacgtaccctaggtcgtacgttcggccgaagggaccgaaggtgaagtacaaccgacgtgtcggctgacc

SEQ ID NO: 215884 - DNA, 504 bp, Homo sapiens
  misc_feature: GYAE6OF02FGJZZ.1.34.D01.1.454.CMB.1.raw
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (374)..(374): a, c, t, g, unknown or other
  misc_feature (374)..(374): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggtgcagcagaaaccngggcacgcccctnagatcgtagtctatggtgcatccagattgcgaaggtgggtcccagtccaggttcagtggcagtgctatcgtgggacagtattacactctcactancagcagcctgcagcctgagtatttgacttaattattactgtacaactagtaattactacgtaccctaggtcgacgtcggaccgacgggacgaaggtagaacgttacgaaccgtaacgtgtacggctgacc

SEQ ID NO: 215885 - DNA, 491 bp, Homo sapiens
  misc_feature: GYAE6OF02GLD1W.1.34.D01.1.454.CMB.1.raw
  modified_base (281)..(281): a, c, t, g, unknown or other
  misc_feature (281)..(281): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctgaagtnttttgctaatttattactgtacaacagtattatacgtaccctagtggtacgttcggccaggggaccaaggtcggaagtcaaccgtactgtaggctgcc

SEQ ID NO: 215886 - DNA, 507 bp, Homo sapiens
  misc_feature: GYAE6OF02IO7M9.1.34.D01.1.454.CMB.1.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggtgcagcagaaaacngggcgagcccctnagatcgtagtctatggtncatccagattgcaaggtcgggtcccatccaggttcagtggcagtgcatcgtgggacagtattacactctacactatcagcagccctgcagctagaagtntttgactaatttattactgactaatagttatatacgtacccgtagtcgacgttcgccgagggtaccaaggtacgaacgtacacgtagtggtggctcgactaccattcgtgttccttacgactttccgtacccgtacc

SEQ ID NO: 215887 - DNA, 548 bp, Homo sapiens
  misc_feature: GYAE6OF02GWH57.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccagggcgagcccctnagatcgtagtctatggtgcatccagattgcaagggtgggtcccatccaggttcaggtggcagtgcatcgtgggacagattacactctacactatcagcagcctgcagcctagaatattttgacttaagttttattacttagtactaactagttaatttataacgttacccctaggttcgggtaacgtttccgggcctaagggggaccctaaaggggtacggtaaacgtaccgaaaccggtacgttaggtacgggtcttcggaaccg

SEQ ID NO: 215888 - DNA, 496 bp, Homo sapiens
  misc_feature: GYAE6OF02HO2TW.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctcagatcgtagtctatggtgcatccagattgcaaggtcgggtcccagtccaggttcagtggcagtgcatctgggacagattacactctacactatcagcagcctgcagcctagaagtntttgactaatttacttactgtacaactagtacttaatacgttaccctagtcggtacttcggcacgggtacctaaggtgaagtcaaccgagtgcgtctgacc

SEQ ID NO: 215889 - DNA, 547 bp, Homo sapiens
  misc_feature: GYAE6OF02JY0HW.1.34.D01.1.454.CMB.1.raw
  modified_base (275)..(275): a, c, t, g, unknown or other
  misc_feature (275)..(275): n is a, c, g, or t
  modified_base (339)..(339): a, c, t, g, unknown or other
  misc_feature (339)..(339): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatcctccctgtctgcatctattggagacagagtcaccatcacttgccggcgagtcaggccatcagcgattcttagctggttgcagcagaaccagggcgagcccctnagactcgtagtctatggtgcatccagattgcaaggtcggtcccatccgaggttcagtggcagtncatcgtgggacagacttacgactctacactatcagcacgcctgctagcctagaagtattttcgacttaatttacttacgtgttaccaaacgttagttaattaacgtacgttaccccgttaggtcggtaccgtttacgggcccgtaaggggtaccctaaagggtagtaacggaccgtaaccgaaccgttggtacgggtctacgtacccg

SEQ ID NO: 215890 - DNA, 519 bp, Homo sapiens
  misc_feature: GYAE6OF02F6FJ1.1.34.D01.1.454.CMB.1.raw
  modified_base (222)..(222): a, c, t, g, unknown or other
  misc_feature (222)..(222): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcagaaaccagggcgacgcccctcagatcgtagtctatggtgcatccagattgcaaggtcgggtcccatccaggttcagtggcagtgcatcgtgggacagattacactctacactatcagcacgcctgcagcctagaagtnttttagacttaaatttattactagtacaacgtagttatatacgtacccttagtcggtacgttcggaccgtagggaccgtaaggtacgtaacgtacgaaccggtactggtcggtactgtacc

SEQ ID NO: 215891 - DNA, 400 bp, Homo sapiens
  misc_feature: GYAE6OF02IQQG0.1.34.D01.1.454.CMB.1.raw
  modified_base (328)..(328): a, c, t, g, unknown or other
  misc_feature (328)..(328): n is a, c, g, or t
  modified_base (377)..(377): a, c, t, g, unknown or other
  misc_feature (377)..(377): n is a, c, g, or t
  modified_base (383)..(400): a, c, t, g, unknown or other
  misc_feature (383)..(400): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtacccctagtggacgttcgccaggggaccaaggtggaagtcaaccgactgtggctgcacatctgtcttnatcttcccaccctctcacgcactcgtctgagccgggtctgggcaaggcncatagnnnnnnnnnnnnnnnnnn

SEQ ID NO: 215892 - DNA, 514 bp, Homo sapiens
  misc_feature: GYAE6OF02IR1YP.1.34.D01.1.454.CMB.1.raw
  modified_base (280)..(280): a, c, t, g, unknown or other
  misc_feature (280)..(280): n is a, c, g, or t
  modified_base (417)..(417): a, c, t, g, unknown or other
  misc_feature (417)..(417): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcaacagaaaccagggcgagcccctnagatcgtagtctagtggtgcatccagattgacaagggtcgggtcccagtccaggttcagtggcagtgcagtcgtgggacagtacttacactctacactatcagcagcctgcagcctagtaagtatttgactaatttntactgtacaatagttattatacgtaccctagtgacgttcggaccgagggaccaagggtagaacgtacgaacgtaactggtacggcgtcgacctaccg

SEQ ID NO: 215893 - DNA, 578 bp, Homo sapiens
  misc_feature: GYAE6OF02F20MK.1.34.D01.1.454.CMB.1.raw
  modified_base (280)..(280): a, c, t, g, unknown or other
  misc_feature (280)..(280): n is a, c, g, or t
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccaggggcgagcccctnagatcgtagtctatggtgcatccagattgcaaggtgggcccatccaggttcagtggcagtgcatcgtgggacagattacactcncactatcagcagcctgcagcctagaagtnttttgacttaaattttactacttgtactaacgtagttaacttaagttaaccgttaccccgttaacggttacgggtaaccggtttaccgggacccggtaacgggggtaaccccgtaaaggggttaccgggaaacggttaccgaaacccgggttaaaccgttgggtacgggtacctacgggtaaccc

SEQ ID NO: 215894 - DNA, 645 bp, Homo sapiens
  misc_feature: GYAE6OF02G13F2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaacccgtaacgttaccgtaaccgtttcgggacccggggtacgtaacggttaccgtaacgggtacccgtaacgttaccgtaacggtaccggtaacgtttaccgttttaacggtacccgttacgggtttacggtaccgtaacggtacccgagaaaccagggcgagcccctcagactcgtagtctatggtgcatccagattgcaaggtgggtcccatcgaggttcagtggcagtgcatcgtgggacagattacactctcactatcagcacgcctgaccaggtccctagaacgttattttcggacttaaagttttacttacttgtactaaacgtgttaattactaacgtaccccttaggtggtaccgttccggacggtacggggaacctaagggtacggtaacgtaccgaaccggtacgttgggtacggtaccgtggtaacccg

SEQ ID NO: 215895 - DNA, 649 bp, Homo sapiens
  misc_feature: GYAE6OF02ILMBJ.1.34.D01.1.454.CMB.1.raw
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttcgccgggcagtcaggccatcagcgattctttagcctggttcncagcagaaaccagggccgacgcccctcacgtagtcgtagtctagtggtgcactccaggtattcggcgtaagggtcggggtccccaagttcccgtaagggtttcaggttcggaccgtaaggtcgactaagtccgttggggaccagtactttaaccgacttcctacaacgtatacgacgtcaacggcctggaccacgcccgttaggaaacgtttagttttcggaactttaagtttttaacttaccgtttaagtaccgtaaactagtttaacttaacgttaaccgttaccccgttaacggttcggtaccggtttacccgggaacggtaacgggtaaccggtaagggtacggtaaacgtaccgtaaaccggtacgttggtacggtcgtacgtacccg

SEQ ID NO: 215896 - DNA, 561 bp, Homo sapiens
  misc_feature: GYAE6OF02JELLL.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcagcccctcagatcgtagtctatggtgcatccagattgcaaggtgggtcccagtccaggttcaggtggcagtgcatcgtgggacagattacactctcactatcagcagcctgcagcctagaagtattttgactaattttacttactacgttacaactagttaattaacgttaacgttaaccccttacggttcggtaaccggtttaccgggacccgtaacgggggaaccctaaagggttcgggaaacggttacccgtaaaccggaaacgttcggtacggtccgttcgacccg

SEQ ID NO: 215897 - DNA, 553 bp, Homo sapiens
  misc_feature: GYAE6OF02GUQTX.1.34.D01.1.454.CMB.1.raw
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctncagtcctgaagtnttttgactaatttattactgtactaactagttaattataacgttaccccgttaagttcggtaccggtttaccgggaccgtacggggggtaaacctaaaggggttacggaaacggttacccgaaaccggtaaacgttcgggtacggtacgttcggaaccc

SEQ ID NO: 215898 - DNA, 857 bp, Homo sapiens
  misc_feature: GYAE6OF02H8HW2.1.34.D01.1.454.CMB.1.raw
  modified_base (694)..(694): a, c, t, g, unknown or other
  misc_feature (694)..(694): n is a, c, g, or t
tcagacgagtgcgtcacgaccggtgctcgatttagatcgtctgtgttgggtttgggggtaggtcgagacccgtgtcaggacacagcatggacatgagggtccccgctcagctctggggctcctgctgctctggctcccaggtacccagctgtgacatccaattgacccagtcctccatccctcctgtctgacacttctagttggacgacagacgttacacctactcacgttcggacccgggtagagtaccgaacgggcctaagttccggaagccgtaacgttttacgttttaaccgccgttgggtttcgacctaacggaccgtaaaacggaaaccccgaagggggccccgtaacgggtcccccccttagaacggaaccgtttaaccgggtaacggttcctttaagggtcgggttacggactaacgttcccgtaaaggttacgtttacggccgttaaaaggggggttccggggttacccctaaaggttcccgtaagggttttcccgtaaagggttcgggggaaccttggttaacgggtccctaaaggttcccgggtagggtaacgtaacggttaactaccgtacttacccgttacaacgttacttacgacgtacgcgtacctcgtacgacgtacgttagtaaacgttgtttacgtaactttaaacgttttaacgtttacgtacgttaaaaaaccncgtttaaacgttaactttaaacgttaacccgttaacccgttaacggtacgggtttaaccggttcccggtaacgggtaaccgggtaacggtaaaccggggttaacgtaaaccggttaccgaaacccggttaacggtacggtacggttaccggaccgttaacccg

SEQ ID NO: 215899 - DNA, 576 bp, Homo sapiens
  misc_feature: GYAE6OF02IALTZ.1.34.D01.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgcgggcagtcaggccatcagcgattcttagctggttncagcagaaccnggcagcccctnagatcgtagtctatggtncatccagtattgcgaagggtcgggtcccagtccgaggttcaggtcggactaggtgacagtcgtaggggaactagtaatttacacttctactaacttatccaagccagtcctagacctagcctagtaagtatttcgacttaattttacttactgtacaacgtattacttaataccgttaaccctaggtacggtaccgtttcggacccggtaaggggtacccgtaaagggttacggaacggttaccgaaaccgggtaaccgttgggtacggtccgttaggtaacccg

SEQ ID NO: 215900 - DNA, 501 bp, Homo sapiens
  misc_feature: GYAE6OF02JHEGV.1.34.D01.1.454.CMB.1.raw
  modified_base (280)..(280): a, c, t, g, unknown or other
  misc_feature (280)..(280): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagtattggacgtaagggtcggggtcccagccgaaggttcaggtggcaggtgggtctggcgacagagttcactctcaccatcagcagcctgcagtctgaatntttgctagtttattactgtcagctagtataataactggcctcggacgttcggaccgaagggactaaggtagaaatcaaacgtacgtgtaggtctgac

SEQ ID NO: 215901 - DNA, 539 bp, Homo sapiens
  misc_feature: GYAE6OF02JDN40.1.34.D01.1.454.CMB.1.raw
  modified_base (255)..(255): a, c, t, g, unknown or other
  misc_feature (255)..(255): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttgccgggcagtcaggccatcagcgattctttagcctggttncagcaagaaaccagggcgacgcccctnagatcgtagtctatggtnacatccagtattgcaaggtcgggtcccagtccgaggttcaggtggcagtgacattcgtgggaacaggacttacacttctcaactatcagcagcctgacacgctagaatntttgactaatttatactagtacaactagttattagtaacgtacccttaggtcggtacgtcggaccgtaagggtaccgtaaggtacgtaacgtaccggaaccgtaacgttcggtacggtccgtagtaaccg

SEQ ID NO: 215902 - DNA, 689 bp, Homo sapiens
  misc_feature: GYAE6OF02G8MNZ.1.34.D01.1.454.CMB.1.raw
  modified_base (579)..(579): a, c, t, g, unknown or other
  misc_feature (579)..(579): n is a, c, g, or t
tcagacgagtgcgtcacgaccggtgctcgatttagatcgtctgtgttgggtttggggagtcaggccagtcagcgattctttaggcctggttgcgaccgcagaaaccaggccgaggcccctcagactcgtagtcgtatcggtgcactccgagtagttgacaaaggtcggggtcccattccgaacggttcacgtcggactacgttcgctactcgtcgggaaccgaggtattaaccactctacaactatcaagtcacggcctagacgaagccttaggaacgtacttttagaacttaagtttacttacagtactaaacgtacgtaagttacgtaaccgtaacccgtaggttacggaaaccgtttcggaaccgtaacggggaccctaaagggtcggtaaacgttaccgaaaccggtaacgtcggtagggtccgtaccgtactaccgtagttcctaggttccgttactaacgttccttaccccgacccgttaccgtaaccgtacgtctaccgtaccgtcgttacgaccgtacgggtcctacgggaactacgggcgactagtagctatgatactagtcagacgaanatatactagtacgtacgtacgacgacgacgtacgtacgtaactaacgtacgtagagtacacgtacgtactactacgtactactactactacgtacctactactactatac

SEQ ID NO: 215903 - DNA, 394 bp, Homo sapiens
  misc_feature: GYAE6OF02JCOKO.1.34.D01.1.454.CMB.1.raw
  modified_base (350)..(350): a, c, t, g, unknown or other
  misc_feature (350)..(350): n is a, c, g, or t
  modified_base (381)..(394): a, c, t, g, unknown or other
  misc_feature (381)..(394): n is a, c, g, or t
tcagacgagtgcgtcacgaccggtgctcgatttagatcgtctgtgttgggtttgggtagtcagaccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtaccccctagtggacgttcgccaggggaccaaggtggaagtcaaccgactgtggctgcaccatctgtcttcatcctcccgccatctgaacncactcgctgagcggctggcaaggcacatagnnnnnnnnnnnnnn

SEQ ID NO: 215904 - DNA, 496 bp, Homo sapiens
  misc_feature: GYAE6OF02FKOR6.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcagtggcagtgcatcgtgggacagattacactctcactatcagcagcctgcagcctagaagtattttgactaattttacttactgttacaactagttaattatacgtaccctagtggacgttcggccgagggaccaagggtgaagtcaaccgagtgtggctgacc

SEQ ID NO: 215905 - DNA, 584 bp, Homo sapiens
  misc_feature: GYAE6OF02GPD9L.1.34.D01.1.454.CMB.1.raw
  modified_base (151)..(151): a, c, t, g, unknown or other
  misc_feature (151)..(151): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (449)..(449): a, c, t, g, unknown or other
  misc_feature (449)..(449): n is a, c, g, or t
tcagacgagtgcgtcacgaccggtgctcgatttagatcgtctgtgttggggtttgggggagtcagaccctgtcaggacacagcatggacatggacggggtcccccgctcagcctccgtggggcctcctgctgctctggctcccaggtaccngaaaaaaaaaaaaaaaactgtgacataccaattcgacccagtcctccactccctccctgtctgcatctagtggagacagagtccaccatccacgttcggccgggcgagtcacggccatcagcgtattctttagcctggttgcagcaagaaaccgngggcgacgccccctnagatcgtagtctagtggtgcatccagtattgacgtaaggggtcgggtacccagtccgtaggttcaggtggcagtgcagtcgtgggacagtactacactctcactatcagcagcctgcagcctagaatntttgactaatttattactgtactaagtagttaacttagtaaccgttaccctaggtcggtaccgttcggacccgaaggggtaaccgtaaggtacggtaacgtaccgaaaccggtaacgtggtacggtctggtaccc

SEQ ID NO: 215906 - DNA, 391 bp, Homo sapiens
  misc_feature: GYAE6OF02H75RX.1.34.D01.1.454.CMB.1.raw
  modified_base (384)..(391): a, c, t, g, unknown or other
  misc_feature (384)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcggcagggaccaaggtggaagtcaaccgaactgtggctgcaccatctgtcttcattcttcccgctactctcgaacgcactcgtctgagcgggctggcaaggcgcatagnnnnnnnn

SEQ ID NO: 215907 - DNA, 582 bp, Homo sapiens
  misc_feature: GYAE6OF02IVKE4.1.34.D01.1.454.CMB.1.raw
  modified_base (280)..(280): a, c, t, g, unknown or other
  misc_feature (280)..(280): n is a, c, g, or t
  modified_base (362)..(362): a, c, t, g, unknown or other
  misc_feature (362)..(362): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctagtggtgcatccagattgcaaggtcgggtcccatccaggttcagtggcagtgcatctgggacagattacnctctcactatcagcagcctgcagcctagtaagtattttgacttaattttacttacgtagtactaacttagttaacttaacgttaacgttaccccgttacggttacgggttaaccggtttccgggtaacccggtaacgggggtacccgtaaacggggttacgggtaaacggttaaccggtaacccggtaaccggttacggtcgggtaccgtcggtaacccg

SEQ ID NO: 215908 - DNA, 498 bp, Homo sapiens
  misc_feature: GYAE6OF02IEWXU.1.34.D01.1.454.CMB.1.raw
  modified_base (253)..(253): a, c, t, g, unknown or other
  misc_feature (253)..(253): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtctccatcctccctgtctgcatctattggagacagagtcacatcacttgccgggcgagtcaggccatcagcgattcttagcctggttgcagcagaaaccagggcgagcccctnagatcgtagtctatggtgcatccagattgcaaggtgggtcccatccaggttcagtggcagtgcatctgggacagattacactctcactatcagcagctgcagcctgaagtatttgactaatttattactgtcaactagtattatagtacccctagtcggacgttcggaccgtagggaccgtaaaggtgaacgtcgaaccgacgtaggtcggctgacacctatctgtcttacacttcctccgtacc

SEQ ID NO: 215909 - DNA, 514 bp, Homo sapiens
  misc_feature: GYAE6OF02JYNT7.1.34.D01.1.454.CMB.1.raw
  modified_base (280)..(280): a, c, t, g, unknown or other
  misc_feature (280)..(280): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcacgcccctnagatcgagtctatggtgcatccagtattgactaagggtcgggtcccagtccaggttcaggtggcagtgcagtcgtagggacagacttacgactctcactatcagcagcctgcagcctagaagtntttgacttaatttatactgtacaatagttattacgtacgtaccctaggtcgtacgtacggccgtaagggacgtaaggtagacgtacaaccggtatggtcggcgtagtacc

SEQ ID NO: 215910 - DNA, 619 bp, Homo sapiens
  misc_feature: GYAE6OF02I119D.1.34.D01.1.454.CMB.1.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcagcccctnagactcgtagtctagtggtgcactccagtattgacgtaagggtcgggtcccatccgaggttcaggtggcagtcgcatcgtgggacagtattacactctacactatcagcacgcctgactacgcctaggtaacgttacttttagaccttaaattttaacttacgttagtaaccaaacgttagtttaactttaacgttaaccgttaaccccgttaacgggttcgggtaaccggtttaccgggaacccggtaacgggggtaaacccgtaaagggggttacggtaaacggttaacccgaaacccgggttaacgttagggtcgggttaccgtacgtaaccccgg

SEQ ID NO: 215911 - DNA, 385 bp, Homo sapiens
  misc_feature: GYAE6OF02JF5MZ.1.34.D01.1.454.CMB.1.raw
  modified_base (374)..(374): a, c, t, g, unknown or other
  misc_feature (374)..(374): n is a, c, g, or t
  modified_base (380)..(385): a, c, t, g, unknown or other
  misc_feature (380)..(385): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaacgaactgtgctgcaccatctgtcttcatcttcccgcatctgaacgcactcgtctgagcggctggacaaggcncatagnnnnnn

SEQ ID NO: 215912 - DNA, 508 bp, Homo sapiens
  misc_feature: GYAE6OF02GCI10.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggtgcagcagaaaccagggcgagcccctcagatcgtagtctatggtgcatccagattgcaagggtcgggtcccatcctaggttcagtggcagtgcagtcgtgggacagacttacactctcatatcacgcagcctgcacgcctagaagtatttgactaatttatactgtacaactagttattatacttaccctagtgacgtcggcgaggggaccaaggtggaaacgtccgaaccgtaacgtggtcggtactgtaaccg

SEQ ID NO: 215913 - DNA, 512 bp, Homo sapiens
  misc_feature: GYAE6OF02GXRQ5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtattttgacttaatttatactgtacaactagttaattacgtaacgtaccctaggttcggtaacggttcggaccgtaggggacctaagggtgaacgtacgaaccggatggcggtctgacc

SEQ ID NO: 215914 - DNA, 561 bp, Homo sapiens
  misc_feature: GYAE6OF02IW6G4.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgacaaggtcgggtcccatccgaggttcaggtggcagtgctagtcgtggggacagtattacactctcacttatcacgcacgcctgacagccctagaagtatttttagacttaattttacttacgttagtactaactagttaatttactaacgttacccctacggttacggtaccggttacggaccggtagggaacccgtaaagggttacggaagttaccgaaccggaacgttcggtacggtacgtcgtaccg

SEQ ID NO: 215915 - DNA, 392 bp, Homo sapiens
  misc_feature: GYAE6OF02GSEWU.1.34.D01.1.454.CMB.1.raw
  modified_base (384)..(392): a, c, t, g, unknown or other
  misc_feature (384)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccaccctcctcacgcactcgtctgagcgggctggcaaggcgcatagnnnnnnnnn

SEQ ID NO: 215916 - DNA, 516 bp, Homo sapiens
  misc_feature: GYAE6OF02IK2HW.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtcgggtcccatccaggttcagtggcagtgcatcgtgggacagtattacactctacactatcagcagcctgcagctagaagtattttgactaatttattactgtacaactagtattaatacgtaacccctaggttcggacgtttcggaccgtaaggggactaaagggtcgaagtcaaccggtacgtggtacggcctaggacc

SEQ ID NO: 215917 - DNA, 490 bp, Homo sapiens
  misc_feature: GYAE6OF02GHSLH.1.34.D01.1.454.CMB.1.raw
  modified_base (483)..(483): a, c, t, g, unknown or other
  misc_feature (483)..(483): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgacttaatttattactgtacaactagttattatacgtaccctagtggacgttcggccagggaccaaggtgaagtcaacgaacgtgnggctgac

SEQ ID NO: 215918 - DNA, 393 bp, Homo sapiens
  misc_feature: GYAE6OF02H5WKY.1.34.D01.1.454.CMB.1.raw
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (385)..(393): a, c, t, g, unknown or other
  misc_feature (385)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaanaccgtattatagtacccctagtggacgttcggccaggggaccaaggtggaagtcaaccgactgtggctgcaccatctgtcttcatcttcccgccatctgaacncactcgtctgagcgggctggcaaggcgcatagnnnnnnnnn

SEQ ID NO: 215919 - DNA, 443 bp, Homo sapiens
  misc_feature: GYAE6OF02IY299.1.34.D01.1.454.CMB.1.raw
  modified_base (232)..(232): a, c, t, g, unknown or other
  misc_feature (232)..(232): n is a, c, g, or t
  modified_base (322)..(322): a, c, t, g, unknown or other
  misc_feature (322)..(322): n is a, c, g, or t
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
  modified_base (404)..(443): a, c, t, g, unknown or other
  misc_feature (404)..(443): n is a, c, g, or t
tcagacgagtgcgtcacgaccggtgctcgatttagatcgtctgtgttggggtttgggagtcaggccatcagcgattctttagcctggttgcagcagaaaccagggcgagccctcagatcgtagtctatggtgcatccagtattgcaaggtgggtcccatccaggttcagtggcagtgcatcgtggggacagagttacactcgtcactatcgagccagcctgcagcctggaanattttgctaatttatactgtacaacagttattatagtacccctagtggacttcggccagggaccaggtgaatcgaaacgactgtggctgnaccatctgtctcatctaccgctatctagaacgnaactcgtctagacgcgggtctgggacctaaagggcactaanagctgcgnnnnnnnnnnnnnnnnnnnnnnnnnnnnnnnnnnnnnnnn

SEQ ID NO: 215920 - DNA, 488 bp, Homo sapiens
  misc_feature: GYAE6OF02FYA4B.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaacagtattatacgtaccctagtgacgttcggccgagggaccaaggtgaagtcaaccgactgtcggctgacc

SEQ ID NO: 215921 - DNA, 392 bp, Homo sapiens
  misc_feature: GYAE6OF02FUY0E.1.34.D01.1.454.CMB.1.raw
  modified_base (379)..(379): a, c, t, g, unknown or other
  misc_feature (379)..(379): n is a, c, g, or t
  modified_base (385)..(392): a, c, t, g, unknown or other
  misc_feature (385)..(392): n is a, c, g, or t
tcagacgagtgcgtcacgaccggtgctcgatttagatcgtctgtgttgggtttgggagtcagtccatcagcgattctttagcctggttgcagcagaaaccagggcgagcccctcagatcgtagtctatggtgcatccagattgcaaggtgggggtcccatccaggttcagtggcagtgcatctgggacagattacactctcactatcagcagccctgcagcctgaagattttgcaatttattactgtcaacagtattatagtacccctacgtggacgttcggccaggggaccaaggtggaagtcaaccgactgtggctgcaccatctgtcttcatcttccgccatctgaacgcactcgtctgagcgggctggcaaggcncatagnnnnnnnn

SEQ ID NO: 215922 - DNA, 538 bp, Homo sapiens
  misc_feature: GYAE6OF02IXF1Z.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctatggtgcatccagattgcaagggtcgggtcccatccaggttcagtggcagtgcatcgtgggacagattacactctcactatcagcagcctgcagcctagaagtattttagacttaaagttttacttactcgtacaactagttaacttaagtaacgttacccctaggtacggtacgttccgggaccgacggggaccgtaagggtcggaagtaccgaaaccggtaacgttggtcggtacctggtacc

SEQ ID NO: 215923 - DNA, 561 bp, Homo sapiens
  misc_feature: GYAE6OF02IT6JZ.1.34.D01.1.454.CMB.1.raw
  modified_base (230)..(230): a, c, t, g, unknown or other
  misc_feature (230)..(230): n is a, c, g, or t
tcagacgagtgcgtcacgaccggtgctcgatttagatcgtctgtgttgggtttgggcatggacatgagggtcccgctcagctcctggggctcctgctgctctggctcccaggtaccagctgtgacatccaattgacccagtctccatcctccctgtctgcatctattgggagacagagtcaccatcacttgccgggcgagtcaggccatcagcgattcttagcctggttncagcagaaaccagggcgagcccctcagatcgtagtctagtggtgcatccagtattgacgtaagggtcggggtacccagtccgaggtttcgagtggctaggtgctatcgtagggacagtattacactctcactatcagcacgcctgcacgcctagaaagtatttagacttaatttattactgtacaactagttattaatacgtaccctaggtgtaccgttcggacgtacgggacgtaaggtaggaacgtacgaaccgtaacgttaggtcggtactcggacctaaccgtacgttcttacgttaccgttcaaccgtttcccttacccctacccc

SEQ ID NO: 215924 - DNA, 392 bp, Homo sapiens
  misc_feature: GYAE6OF02G26YB.1.34.D01.1.454.CMB.1.raw
  modified_base (385)..(392): a, c, t, g, unknown or other
  misc_feature (385)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgaactgtggctgcaccatctgtcttcatcttcccgccatctgaacgcactcgtctgacgcgggctggcaggcgcatagnnnnnnnn

SEQ ID NO: 215925 - DNA, 400 bp, Homo sapiens
  misc_feature: GYAE6OF02HPKYD.1.34.D01.1.454.CMB.1.raw
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (392)..(400): a, c, t, g, unknown or other
  misc_feature (392)..(400): n is a, c, g, or t
tcagacgagtgcgtcacgaccggtgctcgatttagatcgtctgtgttggggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacaactagtattatacgtacccctagtggacgttcggccaggggaccaagggtggaagtcaaccgaactgtggctgcaccatcgtgtcttcactccttcccgcatctgaacgcactcgtctgagcgggctggcaggcnangnnnnnnnnn

SEQ ID NO: 215926 - DNA, 525 bp, Homo sapiens
  misc_feature: GYAE6OF02H3IE9.1.34.D01.1.454.CMB.1.raw
  modified_base (279)..(279): a, c, t, g, unknown or other
  misc_feature (279)..(279): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctatggtgcatccagattgcaaggtcgggtcccatccgaggttcagtggcagtgcatcgtagggacagattacacttctacactatcagcagcctgcagcctagaatntttgactaatttatactgtacaactagtattatacgtaccctaggtacggtaccgttaccgggcgtaacggggacctaagggtacggaacgtaccggaacccgtaacgttggtacggccttgaacccg

SEQ ID NO: 215927 - DNA, 507 bp, Homo sapiens
  misc_feature: GYAE6OF02F65AP.1.34.D01.1.454.CMB.1.raw
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgcgaagggtcgggtcccatccgaggttcagtggcagtgcatcgtgggacagattacactctactactatcagcacgcctgcagcctagaagtnttttagacttaatttattactgtacaatagttaattactacgtaccctagtcggacgttcggccgaagggacaaggtcgaacgtcaacggtacttgcgtctgac

SEQ ID NO: 215928 - DNA, 507 bp, Homo sapiens
  misc_feature: GYAE6OF02JSYD8.1.34.D01.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(507): a, c, t, g, unknown or other
  misc_feature (475)..(507): n is a, c, g, or t
tcagacgagtgcgtcacgaccggtgctcgatttagatcgtctgtgttgggtttgggtagtcaggccatcagcgattctttagcctggttgcagcagaaaccagggcgagcccctcagatcgtagtctatggtgcatccagattgctaaggtggggtcccatccaggttcagtggcagtgcatctgggacagagttacacttcgtcacgtatccagcagcctgcagcctgaanattttgcaattttntactgttcaactagttattatacgtacccctagtggaccgttcgccgagggggtaccaaggttcggaagtccaaaccgaacgtgtagggtcctgaccaccgtatccgtgttcttacgattcccgtttaccccgacccttccgttacaccggctacctccgtctacggacgcggggtcctgggtaccaaagggtccgacttaagtcgaccgntcnganacgnaacntncnnnnnnnnnnnnnnnnnnnnnnnnnnnnnnnnn

SEQ ID NO: 215929 - DNA, 519 bp, Homo sapiens
  misc_feature: GYAE6OF02HGRT8.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtcgggtcccatccaggttcagtggcagtgcatcgtgggacagattacactctcatatcagcacgcctgcagcctagaatattttagacttaaattttactactgtactaactagttattaatacgtaccctagtcggtacgttccggccgaggggtaccaagggtcggaagtaccgaaaccgtaacgttggtcggtctagtacc

SEQ ID NO: 215930 - DNA, 804 bp, Homo sapiens
  misc_feature: GYAE6OF02IJQFF.1.34.D01.1.454.CMB.1.raw
  modified_base (120)..(120): a, c, t, g, unknown or other
  misc_feature (120)..(120): n is a, c, g, or t
  modified_base (123)..(123): a, c, t, g, unknown or other
  misc_feature (123)..(123): n is a, c, g, or t
  modified_base (157)..(157): a, c, t, g, unknown or other
  misc_feature (157)..(157): n is a, c, g, or t
  modified_base (313)..(313): a, c, t, g, unknown or other
  misc_feature (313)..(313): n is a, c, g, or t
  modified_base (546)..(546): a, c, t, g, unknown or other
  misc_feature (546)..(546): n is a, c, g, or t
  modified_base (789)..(789): a, c, t, g, unknown or other
  misc_feature (789)..(789): n is a, c, g, or t
tcagacgagtgcgtcacgaccggtgctcgatttagatcgtctgtgttgggtttggggtagtcagaccctgtcaggacacagcatggacatgaggtccccgctcagctcctgggctcccgngcncgctggtcgcctaccgacgtacgcgtcgtggtanactactactaagttccgaacccgtcgttcctacctaccttcccccgttccgttcgttctaccgtctactttacgttaggttaggaacgaacgaacggttacgtacccaactacgttacccttggtcccggggccggggaccgtagtacggacccgntacgtacgacggtacttacgtttacgtttccgccggttggttcgacgtacgacgaaaacgaaccggacggtaccggacccgtcccctacgaagtacgtacgtacgtacttacggtggtaccacctacgtaccgtagtacgtgaacggtacggggtccgacctaacgtacgtacggttacgaggtcgaagtcgtacgctaacggttgaacgggtactaagtaaccgtttaaccncgttacctaatacgtactacgaccgtacaccgtccgagaccgtaccgtacgttaagttaagtttacgttaaccttaagtttaaacttttaacgtccgtacttaaacgttaacgtttaattaacgtttaaccgtacccgttaacccgttacggttaccgggttaccggttaccgggaacccggttaaaggaaccggttaacgggtaaccgtaaccgttaaccggtaacccgttaggtaccggtntacccgtacggtacg

SEQ ID NO: 215931 - DNA, 508 bp, Homo sapiens
  misc_feature: GYAE6OF02F36M9.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtattttgactaattttattactgtacaactagttattatacgtacccctagtcggtacgttcggccgaaggggaccaagggtgaagtcgaaccgacgtggtggctggacacctatctgtccttacacttccgtcccgtacc

SEQ ID NO: 215932 - DNA, 569 bp, Homo sapiens
  misc_feature: GYAE6OF02JU3W3.1.34.D01.1.454.CMB.1.raw
  modified_base (230)..(230): a, c, t, g, unknown or other
  misc_feature (230)..(230): n is a, c, g, or t
  modified_base (498)..(498): a, c, t, g, unknown or other
  misc_feature (498)..(498): n is a, c, g, or t
  modified_base (532)..(532): a, c, t, g, unknown or other
  misc_feature (532)..(532): n is a, c, g, or t
  modified_base (535)..(536): a, c, t, g, unknown or other
  misc_feature (535)..(536): n is a, c, g, or t
  modified_base (538)..(540): a, c, t, g, unknown or other
  misc_feature (538)..(540): n is a, c, g, or t
  modified_base (542)..(543): a, c, t, g, unknown or other
  misc_feature (542)..(543): n is a, c, g, or t
  modified_base (545)..(545): a, c, t, g, unknown or other
  misc_feature (545)..(545): n is a, c, g, or t
  modified_base (547)..(569): a, c, t, g, unknown or other
  misc_feature (547)..(569): n is a, c, g, or t
tcagacgagtgcgtcacgaccggtgctcgatttagatcgtctgtgttgggtttgggtagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatccagcagcctgcagcctgaagtnttttcgctaaattttatactgtaccaaactagttaatttactaacgtacccccctaaggttcgggaaccgtttccggcccgaagggggaacctaaacgggttagggaaacgttacccgaaacccgaacgttagggtcggtaccttacggacccgtaacccaagtttaccgtcggttccctttacacccgttcccgttttcccccgacctatttcccgtcggaaaacccgtcctaaccgtttcccgtaccgttggacggtcccgggggnttacggggcaaacgggggccttaccagttacggntcnncnnncnncncnnnnnnnnnnnnnnnnnnnnnnn

SEQ ID NO: 215933 - DNA, 380 bp, Homo sapiens
  misc_feature: GYAE6OF02GOZOO.1.34.D01.1.454.CMB.1.raw
  modified_base (373)..(373): a, c, t, g, unknown or other
  misc_feature (373)..(373): n is a, c, g, or t
  modified_base (377)..(380): a, c, t, g, unknown or other
  misc_feature (377)..(380): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtgaagtcaaccgaactgtggctgcacatctgtcttcatcttcccgcatctgaacgcactcgtctgagcggctggcaggcnatgnnnn

SEQ ID NO: 215934 - DNA, 511 bp, Homo sapiens
  misc_feature: GYAE6OF02IW2N3.1.34.D01.1.454.CMB.1.raw
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttgccggtcagtcaggccatcagcgattctttagcctggttgcagcagaaaccagggcgagcccctcagatcgtagtctatgggtncatccagattgcaaggtgggtcccagtccaggtttcagtggcagtgcatcngggacagatttacgactcncactatcaagcagcctgcagcctgaactntttcgntaattttattacgtgtacaactgttaacttataacgtaccctagtggtacgtttcggcgacgggtaacaacggttaggaactacgaacgaactaggtcgtactgaccg

SEQ ID NO: 215935 - DNA, 560 bp, Homo sapiens
  misc_feature: GYAE6OF02HUNMF.1.34.D01.1.454.CMB.1.raw
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
  modified_base (347)..(347): a, c, t, g, unknown or other
  misc_feature (347)..(347): n is a, c, g, or t
tcagacgagtgcgtcacgaccggtgctcgatttagatcgtctgtgttgggtttggggggagtcagaccctgtcaggacacagcatggacatgagggtccccgctcagcctcctggggcctcctgctgctctggctcccaggtaccagctgtgacatccaattgacccagtctccatcctcctgtctgcatctattggagacagagtcaccatcacttggccgggnagtcaggccatcagcgattcttagcctggttgcagcagaaaccagggcgagcccctnagatcgtagtctatggtgcatccagattgcaaggtgggtcccagtccaggttcagtgcagtgacntctgggacagtacttacactctcactatcagcagctgcgagcctgaacgtatttttacgacttaattttagttacgtagtactaacgtagttaatttagtaaccgttaccccgttaggttacgggtaccggttaccggaaccgtaacggggtaacccggtaagggttacggaacggttaccgaaccggaacctgggtacggcgtacgtacccg

SEQ ID NO: 215936 - DNA, 500 bp, Homo sapiens
  misc_feature: GYAE6OF02IJ7KV.1.34.D01.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgctatcgtgggacagtattacactctcactatcagcacgcctgcagccttagaagtattttgacttaaattttattactgtacaactagtaattactacgtaccctaggtcgtacgttcggcgagggaccaaggtgaagtcaacgactggtcgctgacc

SEQ ID NO: 215937 - DNA, 577 bp, Homo sapiens
  misc_feature: GYAE6OF02GLA06.1.34.D01.1.454.CMB.1.raw
  modified_base (274)..(274): a, c, t, g, unknown or other
  misc_feature (274)..(274): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttggggtttgggggagtcagaccctgtcaggacacagcatggacatgacgggtccccgctcagctccgtggggctcctgctgctctggctcccaggtaccagctgtgacatccaattgacccagtctccatcctccctgtctgcatctattggagacagagtccaccatcacttggccgggcgagtcaggccatcagcgtattcttagcctggttgcagcaagaaaccngggcacgcccctacagatcgtagtctatggtgcactccagtattgacgtaagggtcgggtcccatccgaggttcaggtggcagtgacattcgtagggacagtattaccactctactaactatcaagcagccctgcacggtcctagtaacgtnttttaggacttaatttacttaacgtgttaccaaatgtttaacttactaacgtaccccttaggtcggtaaccggttccggaccggtaacgggggacctaaggggtacgtaacggtaccgtaaaccgtacgttaggtcgggtacctgaacccg

SEQ ID NO: 215938 - DNA, 396 bp, Homo sapiens
  misc_feature: GYAE6OF02GM2VG.1.34.D01.1.454.CMB.1.raw
  modified_base (377)..(377): a, c, t, g, unknown or other
  misc_feature (377)..(377): n is a, c, g, or t
  modified_base (384)..(396): a, c, t, g, unknown or other
  misc_feature (384)..(396): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgaactgtgctgcaccatctgtcttcatctccgcatctagaaacgcactcgtctgacgcggctggcaaggcncagtagnnnnnnnnnnnnn

SEQ ID NO: 215939 - DNA, 564 bp, Homo sapiens
  misc_feature: GYAE6OF02G4964.1.34.D01.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagccttggttgcagcaagaaaccagggcgagcccctnagatccgtagtctagtggtgcatccagtattgacgaagggtcgggtcccatccgaggttcaggtggcagtgctagtcgtgggacagtattaccactctacactatcagccagcctgcagtcctagaagtattttagacttaattttacttactgtacaacgttagttaattacgtaaccgttacccttacggttacggtaccgttccgggaccgaaggggtaacctaaggggttacggaaacgttcccgtaaaccggtacgttaggtcggtactagacccg

SEQ ID NO: 215940 - DNA, 582 bp, Homo sapiens
  misc_feature: GYAE6OF02IZDZ7.1.34.D01.1.454.CMB.1.raw
  modified_base (439)..(439): a, c, t, g, unknown or other
  misc_feature (439)..(439): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcacgcccctcagactcgtagtctagtggtgcatccagtattggacgtaagggtcggggtaccccagttacccgtaggtttcgaaggtcggacgtaggtcgactacgtcggtacgggaacaggtacttaacacctctacacttatcagcacgctgcacgtctagaattntttacgattaattttactacgtagtctaactagtttaattactaccgttacccgttagtcgggtacgtttccgggacggtaacgggaccgtaagggtacggaaccgttaccgaaccggtaacgttggtcggtacgtagtaccg

SEQ ID NO: 215941 - DNA, 505 bp, Homo sapiens
  misc_feature: GYAE6OF02HTDKV.1.34.D01.1.454.CMB.1.raw
  modified_base (268)..(268): a, c, t, g, unknown or other
  misc_feature (268)..(268): n is a, c, g, or t
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccnggggcgagcccctcagatcgtagtctatggtgcatccagattgcgaaggtgggtcccatccaggttcagtggcagtgcatcgtgggacagtattacnctctcactatcagcagcctgcagcctagaagtntttcgacttaattttatactgtacaactagttattatacgttaccctagtgtacgttcggcgacgggaccaaggtaggaacgtcgaacgtacgtggtcggtctgacc

SEQ ID NO: 215942 - DNA, 533 bp, Homo sapiens
  misc_feature: GYAE6OF02JCWJN.1.34.D01.1.454.CMB.1.raw
  modified_base (264)..(264): a, c, t, g, unknown or other
  misc_feature (264)..(264): n is a, c, g, or t
  modified_base (357)..(357): a, c, t, g, unknown or other
  misc_feature (357)..(357): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctattggagacagagtcaccatcacttgccgggcagtcaggccatcagcgattcttagcctggttgcagcagaaaccngggcgagcccctcagatcgtagtctatggtgcatccagtattgactaaggtcgggtcccagtccgaggttcagtggcagtgcatcgtgggacngattacactctcatatcgagtcacgctggtcagcctagaagttactttagcttaaatttatacgtcgtacaacgtattaagttactacgttaccctacgttggtaccgttcgggaccgtaggggtacctaagggtgtaacgtactaaccggtaacgtggtacggtcgtaggtaccg

SEQ ID NO: 215943 - DNA, 522 bp, Homo sapiens
  misc_feature: GYAE6OF02HJFPP.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttagggtttggggagtcagaccctgtcacggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctatggtgcatccagattgcaaggtgggtcccatccaggttcagtggcagtgcatcgtgggacagattacactctcactatcagcagcctgcagcctagaactattttgactaatttacttactgtactaactagttaattactacgtaccctagtcggtacgtttccggaccgtaggggacctaagggtggaacgtccgaaccggtaacgttggtacggccgtagtacccg

SEQ ID NO: 215944 - DNA, 557 bp, Homo sapiens
  misc_feature: GYAE6OF02J126W.1.34.D01.1.454.CMB.1.raw
  modified_base (357)..(357): a, c, t, g, unknown or other
  misc_feature (357)..(357): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaccagggcgagcccctcagatcgtagtctatggtgcatccagtattgacaagggtcgggtaccccagtccgaggttcaggtcggctagtgcatcgngggacagtacttacacttctacactatcagcacgcctgcacgctagaagttatttcgacttaattttacttactagtacctaactagttaattactaaccgttacccctaggttacggtacgtttccgggaccgtaacggggtactaagggtacggtaacgtaccgaaaccggtacgtcggtacggtacgtagtaacccg

SEQ ID NO: 215945 - DNA, 602 bp, Homo sapiens
  misc_feature: GYAE6OF02JPYTZ.1.34.D01.1.454.CMB.1.raw
  modified_base (280)..(280): a, c, t, g, unknown or other
  misc_feature (280)..(280): n is a, c, g, or t
  modified_base (436)..(436): a, c, t, g, unknown or other
  misc_feature (436)..(436): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcttccgtgtctgcatctgtcggagacagagtcaccatcacttgtcgggcgagtcgagggtattagcagctggttagccttggtatcagcaagaaaccgagggaaacncccccaaactcctagatctatgctagcataccagtttagaaaggtcgggtaccatacgaaggttcaagtgcagtgactagtcgtaggacagtattacactctactaactatacgaagtcacgtctacggcacgtccgtagaaactttcgttttaanaccgtttaaatttacgttacgttagtacctaaacgtagttaaacttaacgtaacccgttaaccgttcggttaggtacccgttacggacccgtaggggaaccctaagggtacggtaaacgttaccgaacgtaacgtggttacgcgtagaccctacgtattccgtacg

SEQ ID NO: 215946 - DNA, 535 bp, Homo sapiens
  misc_feature: GYAE6OF02GTB26.1.34.D01.1.454.CMB.1.raw
  modified_base (268)..(268): a, c, t, g, unknown or other
  misc_feature (268)..(268): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgacgcccctcagatcgtagtctagtggtgcatccagattgcaaggtcgggtcccatccgaggttcagtggcagtgcatcgtgggacagattacactctcactatcagcagcctgcagcctgaagtnttttagcttaaatttattacgtgtactaactagttaacttacgtaacgtacccttagtcggtaccggttcggaccgtaacggggaccgtaagggtacggaagtaccgaaccggtactacgggtggtacctggtaccc

SEQ ID NO: 215947 - DNA, 531 bp, Homo sapiens
  misc_feature: GYAE6OF02GTJQE.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaacagggcgagcccctcagatcgtagtctatggtgcatccagattgcgaaggtcgggtccatccaggttcaggtggcagtgcatctgggacagattacactctcactatcagcacgcctgcagcctagaagtattttgacttaaattttacttactgttacaactagttaattaacgttacgttaacccctagttacggtaccgttcgggccggaacggggaccaagggtacggtaacgtacgaaccggaccgttaggaggtctgtacc

SEQ ID NO: 215948 - DNA, 390 bp, Homo sapiens
  misc_feature: GYAE6OF02GU6LY.1.34.D01.1.454.CMB.1.raw
  modified_base (378)..(378): a, c, t, g, unknown or other
  misc_feature (378)..(378): n is a, c, g, or t
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccaccctcctcacgcactcgtctgagcgggctggcaaggcncatagnnnnnnn

SEQ ID NO: 215949 - DNA, 794 bp, Homo sapiens
  misc_feature: GYAE6OF02HX1TI.1.34.D01.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtcctgcatctagttcggagacagagtcaccatcacttgccgggcgagtcacggcatcagcgtaattctttagcctggttgcagcagaaaccagggccgacgcccctnagactcgtagtctatggtagcactccgagattcggacgaacgggtgggtccccagttacccgagggtttccaaggttcggactagggtgacctaagttccggttacggggaacctaacgggtaacttttaccgaaccgttttcccgttaccgtaacccgtttaagttaccggaacgggacccgtaaacgggtccctttacgggaacccgtaaggtacccgtttacgggtaaaacggtttaccttttttcggggaaaccttttaaacttttttaaacgtttaccgtttaccggttaacctaaaacgtttaacgtttaacgtttaaacgttaaacccggggtttaacccccgttaaggggttaccggggttaacccggtttttacccggggaacccggttaaaccggggggttaaccgtaaaacgggggtttaccgggtaaaaccgttacccggtaaaacccgggttaaccgttggggttaaccgggttccccgttacggtaaccccg

SEQ ID NO: 215950 - DNA, 391 bp, Homo sapiens
  misc_feature: GYAE6OF02IESU3.1.34.D01.1.454.CMB.1.raw
  modified_base (379)..(379): a, c, t, g, unknown or other
  misc_feature (379)..(379): n is a, c, g, or t
  modified_base (385)..(391): a, c, t, g, unknown or other
  misc_feature (385)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcggcagcctgcagcctgaagattttgctaatttattactgtcaacagtattatagtacccctagtggacgttcggccaggggaccaaggtggaagtcaaccgaactgtggctgcacatctgtcttcatcttcccgcatctgaacgcactcgtctgagcgggctgggcaagggcncatagnnnnnnn

SEQ ID NO: 215951 - DNA, 485 bp, Homo sapiens
  misc_feature: GYAE6OF02G5BUS.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaagtnttttgctaattttatactgtcaacattatatagtaccctagtgacgttcggccaggggacaaggtagaagtcgaaccgactgtcggctgcc

SEQ ID NO: 215952 - DNA, 480 bp, Homo sapiens
  misc_feature: GYAE6OF02IVBWU.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtggggtcccatccaggttcagtggcagtgcatcgtggacagattacactctcactatcagcagcctgcagcctgaagtatttgactaatttattactgtacaactagtattatacgtaccctagtgtacgtcggacgagggacaggtgaagtcacgactgtgctgcacatctgtcttcactcctcctaccc

SEQ ID NO: 215953 - DNA, 475 bp, Homo sapiens
  misc_feature: GYAE6OF02FFPUH.1.34.D01.1.454.CMB.1.raw
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctcagatcgtagtctatggtgcatccagattgcaaggtgggtccatccaggttcagtggcagtgcatctgggacagattacactctcactatcagcagcctgcagcctgaagtattttgctaatttattactgtacaactagtattatagtaccctagtgacgtcgcgagggacaaggtgaagtcaaccgatgtcgctgc

SEQ ID NO: 215954 - DNA, 533 bp, Homo sapiens
  misc_feature: GYAE6OF02F69YU.1.34.D01.1.454.CMB.1.raw
  modified_base (197)..(197): a, c, t, g, unknown or other
  misc_feature (197)..(197): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggttgcagcagaaaccagggcgacgcccctcagatcgtagtctatggtgcatccagattgcaaggtgggtcccatccaggttcaggtggcagtgcatcgtgggacagattacactctcactatcagcacgcctgacagcctagaacgtnttttcgacttaatttattactgtacaactagtattatacgttaccctagtacggtaccgttcggccgtaacggggtacctaagggttaggaacgttaccgaacccggtaacgttggtacggtccgtgtaacccg

SEQ ID NO: 215955 - DNA, 395 bp, Homo sapiens
  misc_feature: GYAE6OF02HNVT4.1.34.D01.1.454.CMB.1.raw
  modified_base (351)..(351): a, c, t, g, unknown or other
  misc_feature (351)..(351): n is a, c, g, or t
  modified_base (384)..(395): a, c, t, g, unknown or other
  misc_feature (384)..(395): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacttcggccaaggggaccaaggtggaagtcaaccgaactgtggctgcaccatctgtcttcatcttcccgcatctgaacncactcgtctgagcgggctggcaaggcgcatagnnnnnnnnnnnn

SEQ ID NO: 215956 - DNA, 499 bp, Homo sapiens
  misc_feature: GYAE6OF02FVOT2.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtnttttgcttaatttattactgtacaactagtattatacgtaccctaggtgacgttcggcgagggaccaaggtgaagtacgaaccgtaacgtggtagtactgtaccg

SEQ ID NO: 215957 - DNA, 532 bp, Homo sapiens
  misc_feature: GYAE6OF02HUZP6.1.34.D01.1.454.CMB.1.raw
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcacgcccctnagatcgtagtctatggtgcatccagattgcaaggtcgggtcccatccaggttcagtggcagtncatcgtgggacagattacactctcactancagcagcctgcacgctagaagtatttgactaatttatactgtacaactagtattactacgtacccctaggtcggtacgttccggacgaggggtaaccaagggtacgaacgtaccgaaccgtaacgttggtacggacctcgaccaccgtatcgttcgtacctttacacttcccttcccctaacccc

SEQ ID NO: 215958 - DNA, 512 bp, Homo sapiens
  misc_feature: GYAE6OF02IHMYR.1.34.D01.1.454.CMB.1.raw
  modified_base (422)..(422): a, c, t, g, unknown or other
  misc_feature (422)..(422): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgacgcccctcagatcgtagtctatggtgcatccagtattgctaaggtcgggtacccatccgaggttcagtggcagtgcatctagggacagtattacactctacactatcagcagctgcagcctagtaagtatttgactaattttatacgtntacaactagtattaatacgttaaccctaggtagtacgttcggacgtagggaccaagggtcgaacgtcaaccgtacgtggtacgctagacc

SEQ ID NO: 215959 - DNA, 507 bp, Homo sapiens
  misc_feature: GYAE6OF02HU6TT.1.34.D01.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtncatccagattgacaagggtcgggtcccatccgaggttcagtggcagtgcatcgtagggacagtattacactctcactatcagcagcctgcagcctagaagtnttttgacttaatttattactagtacaatagttattatacgttaccctagtcggtacgttcggcgtaacgggacaaggtacggaagtcgaacgactggacgctgacc

SEQ ID NO: 215960 - DNA, 518 bp, Homo sapiens
  misc_feature: GYAE6OF02GORKF.1.34.D01.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (357)..(357): a, c, t, g, unknown or other
  misc_feature (357)..(357): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgattcttagcctggttgcagcagaaaccgagggcgacgcccctnagatcgtagtctatggtgcatccagtattgcgtaagggtcgggtcccagtccgaggttcaggtggcagtgcatcgngggacagtacttacactctctactatcagcacgcctgcagcctagaacgttatttgacttaatttattactgtactaatagttaattactacgtaccctagtcggtacgttcggacgtacgggacctaggtcgaagtaccgaacgtacgtggcggctgacc

SEQ ID NO: 215961 - DNA, 391 bp, Homo sapiens
  misc_feature: GYAE6OF02FVJBR.1.34.D01.1.454.CMB.1.raw
  modified_base (331)..(331): a, c, t, g, unknown or other
  misc_feature (331)..(331): n is a, c, g, or t
  modified_base (382)..(391): a, c, t, g, unknown or other
  misc_feature (382)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttnatcttcccgctctgaacgcactcgtctgagcgggctggcaaggcgcatagnnnnnnnnnn

SEQ ID NO: 215962 - DNA, 490 bp, Homo sapiens
  misc_feature: GYAE6OF02HSTRS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtgcatccagattgcaaggtgggtcccatccaggttcagtgcagtgcatcgtgggacagattacactctcactatcagcagcctgcagcctagaagtattttcgactaaatttattactgtacaacagttaattataacgtaccctagtgacgttcggcaagggacaaggtgaagtacaacgactgtcggctgac

SEQ ID NO: 215963 - DNA, 491 bp, Homo sapiens
  misc_feature: GYAE6OF02H05UY.1.34.D01.1.454.CMB.1.raw
  modified_base (300)..(300): a, c, t, g, unknown or other
  misc_feature (300)..(300): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtncatccagattgcaaggtcgggtcccatccaggttcagtggcagtgcatcgtgggacagtattacactctcactatcagcagcctgcagcctagaagtntttgacttaatttattactgtacaatagttattactacgtaccctagtcgtacgttcggccgagggacaaggtgaagtcaacgatgcgctgac

SEQ ID NO: 215964 - DNA, 544 bp, Homo sapiens
  misc_feature: GYAE6OF02I3ZQF.1.34.D01.1.454.CMB.1.raw
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctagtggtncatccagattgcaagggtcgggtcccatccgaggttcagtggcagtgcatcgtgggacagattacgactctactacttatcagtcacgccttgcacgcctagaacgttattttgacttaattttacttctagtactaactagttattacgttaaccgtacccttaacggtgggtaccgtttcggaccggtaagggtaccgaagggttcgaacggttacgaaccgtacttcggtcggtacgtgaccc

SEQ ID NO: 215965 - DNA, 494 bp, Homo sapiens
  misc_feature: GYAE6OF02HYR2Q.1.34.D01.1.454.CMB.1.raw
  modified_base (343)..(343): a, c, t, g, unknown or other
  misc_feature (343)..(343): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggcgagccctcagatcgtagtctatggtgcatcagattgcaaggtggtcccatcaggttcagtggcagtgcatcngggacagattaacactctcactatcagcagctgcagcctagaagtatttgactaaatttattactagtcaaactagttattaatacgtaccctagtgacgttcggacgacgggactaaggtgaagtacgaaccgaacgtgtagtctagacg

SEQ ID NO: 215966 - DNA, 389 bp, Homo sapiens
  misc_feature: GYAE6OF02HCFLE.1.34.D01.1.454.CMB.1.raw
  modified_base (374)..(374): a, c, t, g, unknown or other
  misc_feature (374)..(374): n is a, c, g, or t
  modified_base (380)..(389): a, c, t, g, unknown or other
  misc_feature (380)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgagattttgcaatttattactgtcaacagtattatagtacccctagtggacgttcggccaggggaccaaggtggaagtcaaccgaactgtggctgcaccatctgtcttcatcttccgcatctgacgcactcgtctgagcgggctggcaaggcncatagnnnnnnnnnn

SEQ ID NO: 215967 - DNA, 566 bp, Homo sapiens
  misc_feature: GYAE6OF02HKL5U.1.34.D01.1.454.CMB.1.raw
  modified_base (282)..(282): a, c, t, g, unknown or other
  misc_feature (282)..(282): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccgagggcgagcccctnagatcgtagtctagtggtgcatccagattggcgaaggtcgggtcccagtcctaggttcagtggcagtgcatcgtgggacagacttacnctctcactatcagcagcctgcagctagacgtatttcgacttaagtttattactgtaccaaagtgttaattaataccgttaaccccgttgttacggtaccgtttccgggacccgtaacggggaaccgtaaagggttacgggaaacgttaccgaaaacccgggtaacgttcgggttaacgggtccgtacggtaacccg

SEQ ID NO: 215968 - DNA, 530 bp, Homo sapiens
  misc_feature: GYAE6OF02H9F0L.1.34.D01.1.454.CMB.1.raw
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgtattcttagcctggttgcagcaagaaaccagggcgagcccctnagatcgtagtctagtggtgcatccaagtattgacgtaaggggtcgggtacccatccgtaggttcaggtggacagtgacatcgtagggacagtattacactctacactatcagcagtcctgcagcctagaagttntttgacttaatttattactgtacaactagttaattataacgttaccctagtcggtaccgttcggacgacggggtaacctaaggtagaacgtacgaaccgatggtcggtctgacc

SEQ ID NO: 215969 - DNA, 504 bp, Homo sapiens
  misc_feature: GYAE6OF02GK95G.1.34.D01.1.454.CMB.1.raw
  modified_base (222)..(222): a, c, t, g, unknown or other
  misc_feature (222)..(222): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattcttagcctggttgcagcagaaaccagggcgagcccctcagatcgtagtctatggtgcatccagattgcaaggtggggtcccatccaggttcagtggcagtgcatctgggacagtattacactctcactatcagcagcctagcagcctgaagtntttnctaatttatactgtacaactattaattactaactaccctagtacggtaccgttcggccgtaaggggacctaagggtcgaagtcaaccggtactggtggactgaccg

SEQ ID NO: 215970 - DNA, 546 bp, Homo sapiens
  misc_feature: GYAE6OF02JB5MO.1.34.D01.1.454.CMB.1.raw
  modified_base (143)..(143): a, c, t, g, unknown or other
  misc_feature (143)..(143): n is a, c, g, or t
  modified_base (288)..(288): a, c, t, g, unknown or other
  misc_feature (288)..(288): n is a, c, g, or t
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
  modified_base (515)..(515): a, c, t, g, unknown or other
  misc_feature (515)..(515): n is a, c, g, or t
  modified_base (540)..(540): a, c, t, g, unknown or other
  misc_feature (540)..(540): n is a, c, g, or t
tcagacgagtgcgtcacgaccggtgctcgatttagatcgtctgtgttgggtttgggggtaggtcgagaccctgtcaggacacagcatggacatgaggtcccgctcagctcctgggctcctgctgctctggctcccaggtaccngctgtgacatccaattgacccagtctccatcctccctgtctgcatctagttgagacagagtcacctatcacttggccgggcagtcaggccatcagcgattcttagcctggttagcagccaagaaaccgtgggacacgtcccctanaggactcgagtctagtggtgccattccgaagacttgacgaaggtcgggtcccaatcccgaaggttcaggtgggccaaggttcgctaactcgtagggaccngttaagtacctactcttcaactactcganctacgccctagcactccaatagtattttgcttaaatttatactagttaccaagtattatactatacccctagttgacgttcgacgtaggactaagggngaacgtggaaccctagtgacggttnacgtac

SEQ ID NO: 215971 - DNA, 560 bp, Homo sapiens
  misc_feature: GYAE6OF02GA8BQ.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctcagatcgtagtctatggtgcatccagattgcgaagggtggggtcccatccaggttcaggtggcaggtgcatcgtgggacagtattacacttctactactatcagcagcctgcagtccctagaaagtattttgacttaattttacttaactgttacaactagttattacgttaacgttacccctaggtcggtacgttcgggaccgtaacggggacctaaagggtcggaacgtaccgaacgtacgtggtacggtcctcggacctactgtcgtacgttccttactacctttcccgtccccgtcccc

SEQ ID NO: 215972 - DNA, 511 bp, Homo sapiens
  misc_feature: GYAE6OF02GCEUT.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtatttgactaatttacttactgttacaacagttattatacgttacccctagtggtacgtttcggaccgtaggggaccaagggtaggaacgtacaaccgtacgtggtggctgaccacctatctgtccttcacttcctccctacccc

SEQ ID NO: 215973 - DNA, 485 bp, Homo sapiens
  misc_feature: GYAE6OF02JCZAY.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctgaatatttgctaatttatactgtacaactagttattatacgtaccctagtcgacgttcggccgagggaccaaggtgagtacacgactgtggctgaccg

SEQ ID NO: 215974 - DNA, 593 bp, Homo sapiens
  misc_feature: GYAE6OF02JOQHS.1.34.D01.1.454.CMB.1.raw
  modified_base (229)..(229): a, c, t, g, unknown or other
  misc_feature (229)..(229): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctcctgtctgcatctattggagacagagtcaccatcacttgccgggacgagtcaggccatcagcgattcttagcctggtncagcagaacgagggcgacgccctcagatcgtagtctagtggtgcatcagtattgacgtaacgggtcggggtaccctagtcccgagggttcgaggtggcaggtgctagtcgtagggacagtacttacactctacaactancgagcgacgcctgactcgccgtagtaaacgtnttttacgacttaaatttactttacgtacgttacgaaacttagttaacttaacgttaccgttacccgttacgtacgggtaccgttacgggaccgtagggaaccggtaggtacggaacgtaccgacgtacgtggtacggtctacggtaccaccgtatccgttacgttccttacgtaccttcccttaccctacccc

SEQ ID NO: 215975 - DNA, 550 bp, Homo sapiens
  misc_feature: GYAE6OF02FMRP6.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcagcccctcagatcgtagtctatggtgcatccagattgcaaggtgggtcccatccaggttcagtggcagtgcatctgggacagattacactctcactactcagcagcctgcagcctagaagtattttgactaatttattactgtactaactagttaatttactacgttaccccttaggtacggtaccggtttaccgggcccgaacgggggtaacccgtaaagggttcggaaacggttaccgtaaaccggtaaccgttcggtacggtaccgtgtaacccg

SEQ ID NO: 215976 - DNA, 514 bp, Homo sapiens
  misc_feature: GYAE6OF02HQIWY.1.34.D01.1.454.CMB.1.raw
  modified_base (280)..(280): a, c, t, g, unknown or other
  misc_feature (280)..(280): n is a, c, g, or t
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctagtggtgcatccagattgctaagggtcgggtcccatccaggttcaggtggcagtgcagtcgtgggacagtattacactctcactatcagcacgcctgcagcctagaagtnttttgacttaatttattactgtacaatagttaattatacgtaccctagtgtacgttcggactacggggaccaagggtacggaacgtacgaaccggaactggtacgctagacc

SEQ ID NO: 215977 - DNA, 526 bp, Homo sapiens
  misc_feature: GYAE6OF02GDY42.1.34.D01.1.454.CMB.1.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (421)..(421): a, c, t, g, unknown or other
  misc_feature (421)..(421): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctagtggtncatccagtattggactaaggggtcgggtacccagtccgaggttcaggtcggcagtgcatcgtgggaacagtacttacactcgtactactatcaagccacgcctgcacgtcctagaacgtnttttgacttaatttattactgtacaactagtattatacgtaccctagtcggacgttcggacgacgggaacaagggtgaagtacaaccggagtggtcgacgtgacc

SEQ ID NO: 215978 - DNA, 484 bp, Homo sapiens
  misc_feature: GYAE6OF02G3M32.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtccatccaggttcagtggcagtgcatcgtgggacagattacactctcactatcagcagcctgcagcctagaagtatttgactaatttattactgtacaactagtattatacgtaccctagtgtacgttcggcagggaccaggtcgaagtcaacgatgtcggctgacactatctgtcttcacttctcccac

SEQ ID NO: 215979 - DNA, 506 bp, Homo sapiens
  misc_feature: GYAE6OF02FH6O9.1.34.D01.1.454.CMB.1.raw
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtncatccagattgcaaggtgggtcccatccaggttcagtggcagtgcatcgtgggacagattacactctcactatcagcagcctgcacgcctgaagtatttgctaatttattactgtacaacagtattactagtacccctagtcggtacgttcggaccgtaggggacctaagggtgaacgtccgaaccgactggtcggctcgcaccatcctgtcttcgacttcctcccgtcccc

SEQ ID NO: 215980 - DNA, 518 bp, Homo sapiens
  misc_feature: GYAE6OF02F9OUG.1.34.D01.1.454.CMB.1.raw
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtncatccagattgacgaaggtcgggtcccatccaggttcagtggcagtgcatcgtgggacagattacactctcactatcagcagcctgcagcctagaatattttgacttaatttacttactgtactaactagttattatacgtacccctaggtcgtacgttcggccgtaagggacctaaggtacggaagtaccgaaccggtactcggtaggcgtgtacccg

SEQ ID NO: 215981 - DNA, 521 bp, Homo sapiens
  misc_feature: GYAE6OF02I2I70.1.34.D01.1.454.CMB.1.raw
  modified_base (283)..(283): a, c, t, g, unknown or other
  misc_feature (283)..(283): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctnagatcgtagtctagtggtgcatccagattgacgaagggtcgggtcccatccgaggttcaggtggcagtgcatcgtgggacagattacactctacactatcagcacgcctgcagcctagaattattttagacttaatttattactntaccaatagttaattacgtacgtacccttaggtacgtacgttcggaccgaggggaccaaggtcgaagtaccgaaccggtatggtcggctagcc

SEQ ID NO: 215982 - DNA, 564 bp, Homo sapiens
  misc_feature: GYAE6OF02IIG3G.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgagcccctcagatcgtagtctatggtgcactcagattgcgaagggtcgggtcccatccgaggttcaggtggctagtgacatcgtgggacagtattacactctacactatcagccagcctgcagcctagaacgtattttagacttaatttattacttagtactaacgtagttaacttactaacgttaccccgttaggtcggtaccggttaccggccggtaacggggtaacctaaggggtacggaaacgttacccggaaaccggtaacgttcgggtacggtccgtggtaaccc

SEQ ID NO: 215983 - DNA, 483 bp, Homo sapiens
  misc_feature: GYAE6OF02HREOA.1.34.D01.1.454.CMB.1.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (481)..(481): a, c, t, g, unknown or other
  misc_feature (481)..(481): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttncagcagaaaccagggcgagcccctcagatcgtagtctatggtncatccagattgcaaggtggtcccatccaggttcagtgcagtgcatctgggacagattacactctcactatcagcagcctgcagcctagaagtattttgactaatttattactgtactaatagttattatacgtaccctagtgtacgttcggcgacgggacaaggtgagtcaacgatgtagctnac

SEQ ID NO: 215984 - DNA, 499 bp, Homo sapiens
  misc_feature: GYAE6OF02HJFYI.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtntttgactaatttattactgtcaactagtaattatacgtaccctagtggtacgttcggccgtacggggaccaagggtggaacgtcgaaccgtagtgtcggctgacc

SEQ ID NO: 215985 - DNA, 480 bp, Homo sapiens
  misc_feature: GYAE6OF02HIXK5.1.34.D01.1.454.CMB.1.raw
  modified_base (428)..(429): a, c, t, g, unknown or other
  misc_feature (428)..(429): n is a, c, g, or t
  modified_base (431)..(434): a, c, t, g, unknown or other
  misc_feature (431)..(434): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(449): a, c, t, g, unknown or other
  misc_feature (448)..(449): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (456)..(464): a, c, t, g, unknown or other
  misc_feature (456)..(464): n is a, c, g, or t
  modified_base (466)..(471): a, c, t, g, unknown or other
  misc_feature (466)..(471): n is a, c, g, or t
  modified_base (473)..(473): a, c, t, g, unknown or other
  misc_feature (473)..(473): n is a, c, g, or t
  modified_base (475)..(480): a, c, t, g, unknown or other
  misc_feature (475)..(480): n is a, c, g, or t
tcagacgagtgcgtcacgaccggtgctcgatttagatcgtctgtgttagggtttagggagtcgaggccgatcagcgattctttagcctgggttgccagcagaaaccagggccgagccccctcagactcgtagtctactggttgcatcctagattgcaaggtcggggtccccatccaggttcagtggccagtgcatctgggaccaggattacactctcactatcagcagcctagcagacctagaagattttgcaatttattactagtacaaccagtattagtacgtaccccttagtggtacgttcggccaggggtaccaaggtggaacgtcaaccggaactcgtggctgctaccatcgtgtccttcacgtcttcccggccatctgaaaccgctactcgtctgacgtcgggctaggcaaggcgacatagnntnnnnancacatncntngnngantncnnnnnnnnncnnnnnncncnnnnnn

SEQ ID NO: 215986 - DNA, 524 bp, Homo sapiens
  misc_feature: GYAE6OF02GXX1O.1.34.D01.1.454.CMB.1.raw
  modified_base (282)..(282): a, c, t, g, unknown or other
  misc_feature (282)..(282): n is a, c, g, or t
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctnagatcgtagtctagtggtgcatccagattgcgtaagggtcgggtcccatccgaggttcagtggcagtgcatcgtgggacagacttacactctcactatcagcagcctgcagcctagaagtnttttgacttaatttattactgtactaactagttattataccgttaccctagtcggtacgttccggaccgtaagggacctaagggtacgaacgtacaaccggtacgtggtacggtcgtgacc

SEQ ID NO: 215987 - DNA, 388 bp, Homo sapiens
  misc_feature: GYAE6OF02IFM1W.1.34.D01.1.454.CMB.1.raw
  modified_base (381)..(388): a, c, t, g, unknown or other
  misc_feature (381)..(388): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaagggtggaagtcaaccgactgtggctgcaccatctgtctcatcttcccgcatcgaacgcactcgtctgagcgggctggcaaggcgcatagnnnnnnnn

SEQ ID NO: 215988 - DNA, 391 bp, Homo sapiens
  misc_feature: GYAE6OF02GK1GJ.1.34.D01.1.454.CMB.1.raw
  modified_base (384)..(391): a, c, t, g, unknown or other
  misc_feature (384)..(391): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtaccccctagtggacgttcggccaggggaccaaggtgaagtcaaccgaactgtggctgcaccatctgtcttcatcttcccgcatctgacgcactcgtctgacgcgggctggcaaggcgcatagnnnnnnnn

SEQ ID NO: 215989 - DNA, 571 bp, Homo sapiens
  misc_feature: GYAE6OF02ITLFG.1.34.D01.1.454.CMB.1.raw
  modified_base (284)..(284): a, c, t, g, unknown or other
  misc_feature (284)..(284): n is a, c, g, or t
  modified_base (565)..(565): a, c, t, g, unknown or other
  misc_feature (565)..(565): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttcgcagcaagaaaccgagggcgacgcccctnagatcgtagtctagtggtgcatccagtatttcgacgtaaggggtcggggtcccctagtcccgtaagggttccaggtcggactaagtcgcatcgtagggacagtactacactctacactatcagcacgcctgacagtcctagtaacgtatttacgactaatttttactaactgtacaacgtagttacttaacgtaacgttacccgtaggttcgtaacggttccggacggtaacgggaccgtaagggttacggaacgtaccgaacggtacgtaggtcggtacncgtacc

SEQ ID NO: 215990 - DNA, 510 bp, Homo sapiens
  misc_feature: GYAE6OF02GTGSF.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcaggtggcagtgcatcgtgggacagattacactctcactatcagcagcctgcagcctgaagtattttgacttaattttattacgttgtacaactagttaattactaacgttacccctagtcggtacgttcgggaccgagggacctaagggtcggaagtcaaccggactggtgtctgac

SEQ ID NO: 215991 - DNA, 792 bp, Homo sapiens
  misc_feature: GYAE6OF02IMS28.1.34.D01.1.454.CMB.1.raw
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
tcagacgagtgcgtcacgaccggtgctcgatttagatcgtctgtgttgggtttggggtagtcgagacctgtcaggacacagcatggacatgaggtcccgctcagctcctcgggctccgtgctgctcgtgctccaggtaccagctgtgacatccaatgacccagtctccatcctccctgtctcgcactcttagttggacggacaggacttcaaccncttacnccgtttgacccgggggcaacgttcaacgggccaacttcgaggccgattttacgttacgccgttcggtttaggccacggtacaaccggtaaaacccgtaggggaccggtaacgccccccgttacgaacggtaactcggttacgtacttaaccgtgggttaacgtccatccgacggtaaagtttcgacgtaaacggggttcgggtaacccctaacgtcccgtaaagggttccaaggttcgggacgtcgttaggccaaggttccggttacgggaaccgtaagaacttttaccgaaaccgtcgtttaccaaccctttaagccgttaaagccgtaaagccgttaaccggctaaacgggtcccctaagtaaagggtttacttttacccggttataaaacggtttttactaacgttcgtttaacaaaccttacgtttaaatattaaacccgggtaccccgttaagttcggggtaacgtttccggaaaccccgggttaggggaaccgtaaaccggttttaaggggacccgttaagaaacccggtaccgttaaacgggtttggacccggttaaccccggg

SEQ ID NO: 215992 - DNA, 652 bp, Homo sapiens
  misc_feature: GYAE6OF02JM49T.1.34.D01.1.454.CMB.1.raw
  modified_base (197)..(197): a, c, t, g, unknown or other
  misc_feature (197)..(197): n is a, c, g, or t
  modified_base (270)..(270): a, c, t, g, unknown or other
  misc_feature (270)..(270): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagccttggttgctagcagaaaccgngggcgacgcccctcagatcgtagtctagtggtgcatccagtacttgacgtaagggtcgggtacccaagttccgtaggttcgaaggttcggactaggtcgactagtcgtaggggacaggtacttaccgactacgtcaactactcagcacgcctgcacgctagaagttctttagacgttaattttactacttacgtaacctaacgttaagtttaactttaacgtaaacccgttacccccgttaaggttaccgggttaccggtttaacccgggtcccgggtaaacggggttaacccggtaaaggggttaaccggggtaaaccggttacccggtaaaacccgggtaaaccggttgggtaaccgggttacccgtacggtaacccccg

SEQ ID NO: 215993 - DNA, 514 bp, Homo sapiens
  misc_feature: GYAE6OF02IF9RZ.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagccccctnagatcgtagtctatggtgcatccagtattgcgaaggtcgggtcccatccgaggttcaggtggcagtgcatcgtagggacagtattacactctacactatcagcagcctgcagcctagaagtatttagacttaatttatactgtacaactagttacttatacgttaccctaggtcgtaccgttcggaccgagggacctaagggtcgaacgtcaacggtactggtcggctgaccc

SEQ ID NO: 215994 - DNA, 494 bp, Homo sapiens
  misc_feature: GYAE6OF02FRIB9.1.34.D01.1.454.CMB.1.raw
  modified_base (281)..(281): a, c, t, g, unknown or other
  misc_feature (281)..(281): n is a, c, g, or t
  modified_base (395)..(395): a, c, t, g, unknown or other
  misc_feature (395)..(395): n is a, c, g, or t
  modified_base (486)..(486): a, c, t, g, unknown or other
  misc_feature (486)..(486): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctagaagtnttttgactaatttattacgtgtacaactagtattatacgtaccctagtcggacgttcggcgagggaccaaggtggaagtcgaacgacgtgnggctgacc

SEQ ID NO: 215995 - DNA, 503 bp, Homo sapiens
  misc_feature: GYAE6OF02HBRD4.1.34.D01.1.454.CMB.1.raw
  modified_base (403)..(403): a, c, t, g, unknown or other
  misc_feature (403)..(403): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggcgacgcccctacagatcgtagtctagtggtgcatccagattgacgaaggtcgggtcccatccgaggttcagtggcagtgacatcgtgggacagattacactctcactatcagcacgctgcagcctagaagtntttcgacttaattacttacgtgtacaatagttattatacgtaccctagttgtacgtcggacgacgggactaaggtcgaagtacaacgtatggtcgctgac

SEQ ID NO: 215996 - DNA, 386 bp, Homo sapiens
  misc_feature: GYAE6OF02FJCFP.1.34.D01.1.454.CMB.1.raw
  modified_base (375)..(375): a, c, t, g, unknown or other
  misc_feature (375)..(375): n is a, c, g, or t
  modified_base (381)..(386): a, c, t, g, unknown or other
  misc_feature (381)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctacgtggacgttcggccaggggaccaaggtggaagtcaaccgaactgtggctgcacatctgtcttcatcttcccgcatctgaacgcactcgtctgagcggctggcaaggcncatagnnnnnn

SEQ ID NO: 215997 - DNA, 522 bp, Homo sapiens
  misc_feature: GYAE6OF02GKAD5.1.34.D01.1.454.CMB.1.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattctttagcctggttgcagcagaaaccnggggcgacgcccctcgagatcgtagtctatggtgcatccagattgacaaggtcgggtcccatccaggttcagtggcagtgcatcgtgggacaggattacactctcactatcagcagcctgcagcctagatntttgactaatttatactntacaactagtattatacgtaccctaggttcgtacggttcggcgtaacggggacctaagggtaggaacgttaccggaaccgtaacgttggtcgggtactgtaacccg

SEQ ID NO: 215998 - DNA, 569 bp, Homo sapiens
  misc_feature: GYAE6OF02JUFQZ.1.34.D01.1.454.CMB.1.raw
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcagaaaccgagggcgacgcccctgagatcgtagtctatggtncatccagtattgacgtaaggtcgggtcccagtccgaggttcaggtggcagtcgcatcgtagggactagatacacgtctactaactatacagcacgcctagccacgcctagaagttatttcgacttaagtttacttactacgtactaacgtagtttaatacgttaaccgtaacccgttaggtacggtaccggtttacggaccggtaacgggtacgtaaggttacggtaacgttaccgtaacgtaacgttggtacggttcgacggtaccc

SEQ ID NO: 215999 - DNA, 574 bp, Homo sapiens
  misc_feature: GYAE6OF02HE4M2.1.34.D01.1.454.CMB.1.raw
  modified_base (280)..(280): a, c, t, g, unknown or other
  misc_feature (280)..(280): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagtattgcgaaggtcggggtcccatccgaggttcagttggcaggtgcagtcngggacagattacncgtcncactancagcagcctgcagcctagaagtattttgactaattttacttactgtacctaacgtagttaattactaaccgttaccccgttaacggtcggtaaccggttttccgggaccgtaaccgggggaaccgtaaacggggttcggaaaccggttaccgtaaacccggtaaccgttcggggtacggtccgttacggtacccg

SEQ ID NO: 216000 - DNA, 625 bp, Homo sapiens
  misc_feature: GYAE6OF02G45GG.1.34.D01.1.454.CMB.1.raw
  modified_base (236)..(236): a, c, t, g, unknown or other
  misc_feature (236)..(236): n is a, c, g, or t
tcagacgagtgcgtcacgaccggtgctcgatttagatcgtctgtgttgggtttggggcatggacatgagggtccccgctcagctcctggggctcctgctgctctggctcccaggttaccagctgtgacatccaattgacccagtctccatcctccctgtctgcgatctattggagacaggagtcaccatcacttggccgggcagtcaggccatcagcgattctttagcctgggttncagcagaaaccagggcgacgcccctacgagatcggtagtctatggtgcatccagattggctaagggtcgggtcccatcccgagggttcagtcggctaggtgcatcgtagggacaagattacactctcaactatcagcagcctgcagcctagtaagtatttgactaatttaacgttactgtactaagtagttaatttaacttacgttaaccccgtaggttacgggtaccgttaccgggaccgtaacgggggaacccaaaggggttacggaacggttaccgaaacccggtaacttacgggtacgggtacccggttacggaccccgtaacccgtagttacccgtttaggtttacccctttaccgtacctttccccgttcccccggtaacccc

SEQ ID NO: 216001 - DNA, 521 bp, Homo sapiens
  misc_feature: GYAE6OF02F3OL1.1.34.D01.1.454.CMB.1.raw
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtgcccgctcagctcctgggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtccatccgaggttcagtggcagtgcatcgtgggacagaattacactctcactatcagcagcctgcagcctgaagtnttttgactaatttacttacgtgttaccaatagttaattactacgttacccctagtcggtacgttcgggacctaagggggaccctaaggggtcggaacgtaccaaaccggaactggtacggctacgg

SEQ ID NO: 216002 - DNA, 519 bp, Homo sapiens
  misc_feature: GYAE6OF02HE9VG.1.34.D01.1.454.CMB.1.raw
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (374)..(374): a, c, t, g, unknown or other
  misc_feature (374)..(374): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccagggcgacgcccctnagatcgtagtctatggtgcatccagtattgacgtaagggtcgggtacccagtccgaggttcaggtggcagtgcatcgtgggacagtactacnctctcactatcagcacgcctgcacgcctagaagttntttcgacttaattttacttactagtactaatagttattactaccgtaccctaggtcgtacggtccggacgagggactaaggtcgaagtaccgaacgtatggcgtctgac

SEQ ID NO: 216003 - DNA, 524 bp, Homo sapiens
  misc_feature: GYAE6OF02G68EB.1.34.D01.1.454.CMB.1.raw
  modified_base (267)..(267): a, c, t, g, unknown or other
  misc_feature (267)..(267): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcagcccctcagatcgtagtctatggtgcatccagattgacaagggtcgggtcccagtccgaggttcagtggcagtgcatcgtggacagattacactctacactatcagcagcctgcacgcctagagtattttgacttaatttacttactgtactaactagttattaactaccgtaccctacgtcggtacgttcggacggtacgggacctaagggtacgtaacgtacgaaccgtacgtcggtacggtcgtgaccg

SEQ ID NO: 216004 - DNA, 547 bp, Homo sapiens
  misc_feature: GYAE6OF02G9OUQ.1.34.D01.1.454.CMB.1.raw
  modified_base (258)..(258): a, c, t, g, unknown or other
  misc_feature (258)..(258): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcgacgcccctnagatcgtagtctatggtgcatccagattgctaagggtcggggtcccatccaggttcaggtggcagtgcatcgtgggacagattacactctcactatcagcagcctgcagcctagaagtatttgacttatttattactntacaactagtattatacgtaccctaggtacggtacgttcggaccgtacggggaactaagggtacgaacgtaccgaaccgtagtcggtcggccttcggacctaaccgtagttccgttacgttcctttaccgactttcccgttaccccgtacc

SEQ ID NO: 216005 - DNA, 512 bp, Homo sapiens
  misc_feature: GYAE6OF02GM9RD.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagccttgttgcagcagaaaccagggcgagcccctcagatcgtagtctatggtgcatccagattgcaagggtgggtcccatccgaggttcagtggcagtgcatcgtgggacagatacgactctcactatcagcagcctgcagcctgaatatttgacttaatttatactgtacaactagtaattaactacgttaccctaggttcgtacgttcggaccgagggtaaccgaaggtacggaagtacgaaccgaacgtggacggtctagtacc

SEQ ID NO: 216006 - DNA, 572 bp, Homo sapiens
  misc_feature: GYAE6OF02HE1F1.1.34.D01.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgacgcccctnagatcgtagtctagtggngcactccagattgacgtaagggtcgggtcccagtccgaggttcaggtcggcagtgcagtcgtagggacagtacttacactctcactatcagcagctgcacgcctagaatattttgacttaaatttatacgtcgtactaaacgtagttaacttacgtaaccgttaccccgttaggtacggtaccggtttccgggacccggtaagggggtaaccctaaaggggtacggtaaacggtcccgaaaccggtacgttcggtacgggtacctggtaaccc

SEQ ID NO: 216007 - DNA, 544 bp, Homo sapiens
  misc_feature: GYAE6OF02JETEE.1.34.D01.1.454.CMB.1.raw
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (425)..(425): a, c, t, g, unknown or other
  misc_feature (425)..(425): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagccttggttgcagcaagaaaccagggcgacgcccctnagactcgtagtctagtggtncatccagtattgacaagggtcgggtcccatccgaggttcaggtgcagtgcatcgtgggacagtattacactctctactatcagcacgcctgacgacgcctagaattatttgacttaaagtttnttaactgtaacaacgtagttaacttaataccgtacccttacgtgtaccgtacggccgtaagggtaccgtaaggtagaacgtaccgaaccgtaacgttacggtacggtacgtcgtaaccg

SEQ ID NO: 216008 - DNA, 515 bp, Homo sapiens
  misc_feature: GYAE6OF02GL1G9.1.34.D01.1.454.CMB.1.raw
  modified_base (282)..(282): a, c, t, g, unknown or other
  misc_feature (282)..(282): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgcaaggtcgggtcccagtccaggttcagtggcagtgcatcgtgggacagattacactctcactatcagcagcctgcagcctagaagtntttgacttaatttacttactgtactaactagttaattatacgttaccctagtcgtacgttcggaccgaggggtaccaagggtcggaacgtccgaaccgtacgtggtcggctgtaccg

SEQ ID NO: 216009 - DNA, 507 bp, Homo sapiens
  misc_feature: GYAE6OF02H0CNQ.1.34.D01.1.454.CMB.1.raw
  modified_base (280)..(280): a, c, t, g, unknown or other
  misc_feature (280)..(280): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattctttagcctggttgcagcaagaaaccagggcgagcccctnagatcgtagtctatggtgcatccagattgctaaggtgggtcccagtccaggttcagtggcagtgctatctgggacagaattacactctacactatcagtcagcctgcancctagaagtntttgattaatttattactgtaacattagtattaatacgtaacccttagtgacgttcggaccgagggaccaaggtacggaagtcgaaccgtaacgtgtacggcgtgacc

SEQ ID NO: 216010 - DNA, 545 bp, Homo sapiens
  misc_feature: GYAE6OF02GIHOC.1.34.D01.1.454.CMB.1.raw
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctggttcaggacacagtcatggacatgagggtccccgctcagctcctggggctcctgcgtgctctggctccccagggtaccagctgtgacatccaattgacccagtctccatcctccctgtctgctatctattggagacagagtcaccatcgacttgccgggcgagtcaggtccatcagcgattctttagcctggttgcagcaagaaacccagggcacgcccctcgagatcgtatctatggtgcatccagattcgacaaggtcgggtcccagtccaggttcaggtcggcagtgcatcgtaggggactagacgttaacacgttctactactatcagcagccngcacgcctgaagtatttggacttaagtttattacgtcgttacaacgtagtacttaagtaccgtaccctaggtcgacgttcggccgaacgggtaccgaaggtacggagttaccgacgtaacgtcggtcggctcgaccg

SEQ ID NO: 216011 - DNA, 576 bp, Homo sapiens
  misc_feature: GYAE6OF02JANN4.1.34.D01.1.454.CMB.1.raw
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcagaaaccagggcgagcccctnagatcgtagtctatggtncactccagattgacgtaagggtcggggtaccccagttcccgaggttccaggtcggcagtgcagtcgtgggaacagtacttacactctacactatcagcacgcctgacacgtccgtagtaagttactttgaacttaatttacttacgtgtaactaacgtagtttaacttacgttaaccgttacccgttacggtacggttaccggttccggaccgggaacgggtaaccgtaagggtacgtaacgtaccgaacggtaacgtggtacggtactacgtacccg

SEQ ID NO: 216012 - DNA, 405 bp, Homo sapiens
  misc_feature: GYAE6OF02INS1V.1.34.D01.1.454.CMB.1.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (400)..(405): a, c, t, g, unknown or other
  misc_feature (400)..(405): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaccgaggcgacgcccctnagatcgtagtctagtggtncatccagattgcaaggtggcccatccgaggttcagtggcagtncatcgtgggacagtattacactctacactatcagcacgcctgcagctagagttactnnnnnn

SEQ ID NO: 216013 - DNA, 692 bp, Homo sapiens
  misc_feature: GYAE6OF02JWE7Q.1.34.D01.1.454.CMB.1.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
tcagacgagtgcgtcacgaccggtgctcgatttagatcgtctgtgttgggtttgggggtaggtcgagaccctgtcaggacacagcatggacatgagggtccccgctcagctcctgggctcctgctgctctggctcccaggtaccagctgtgacatccaattgacccagtctccatcctccctgtctgccatctattgganacagatcaccatccacttgccgggcgaagtcaggccatcgagcgtatttctttacgccgttggttncgagtcaacggaaaccgaggggacaccggccccctagacgaattcggtaagtctaacgtggtcgcactccgagtagttcgacgtaagggtccgggtcccattccgtaacggttcaggtggtctaggtacgctaacgttcggacgggtacctaaggtactttaacgtacgttcctaaccgtaacttataccgtaacgacctaacggtccctaggcctaaccggaccgttagtaaacgtttagttttaccgtaaacttttaatttaaccgtttacgtacgttaacctaacgttaacgtttaactttaaacgtaccgtttaaccccctaggggtacgttaaccgggtttccgggaaccggtaaggggtaacctaacggggttaggaacccggttacgtaaccggacgttagtacgggtctaacggaccc

SEQ ID NO: 216014 - DNA, 538 bp, Homo sapiens
  misc_feature: GYAE6OF02G29GP.1.34.D01.1.454.CMB.1.raw
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggttgcagcagaaaccagggcgacgcccctnagatcgtagtctatggtncatccagattggcgaagggtcgggtcccatccgaggttcaggtgcagtcgcagtcgtgggactaggacttacactctacactatcgagcacgcctgccaggcctaggaacgttntttgacttaatttacttactgtacaatagttatacgttacgtacccctaggtacggtaccgttcggaccgaaggggaccgtaaggagtacgactaccgagtggtcggctagccactagtcttacgtcttacgacttccgtcccgtac

SEQ ID NO: 216015 - DNA, 380 bp, Homo sapiens
  misc_feature: GYAE6OF02F96RU.1.34.D01.1.454.CMB.1.raw
  modified_base (344)..(344): a, c, t, g, unknown or other
  misc_feature (344)..(344): n is a, c, g, or t
  modified_base (370)..(370): a, c, t, g, unknown or other
  misc_feature (370)..(370): n is a, c, g, or t
  modified_base (375)..(380): a, c, t, g, unknown or other
  misc_feature (375)..(380): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgatgtggctgcacatctgtctcatctccgcatctgaacncactcgtctgagcgggctggcaggcncatgnnnnnn

SEQ ID NO: 216016 - DNA, 501 bp, Homo sapiens
  misc_feature: GYAE6OF02JGO0R.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcaggcccctcagatcgtagtctatggtgcatccagattgcaaggtgggtcccatccaggttcagtggcagtgcatctgggacagattacactctcactatcagcacgcctgcagcctagaatattttgctaatttattactgtacaacagttattatagtaccctagtggacgttcggccgtagggaccgtaaggtaggaagtaccgaacgtaactaggtaggtctgacc

SEQ ID NO: 216017 - DNA, 649 bp, Homo sapiens
  misc_feature: GYAE6OF02HTSV3.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttggggggagtctagaccctgtcaggacacagcgatggacatgagggtccccgctcagctcctggggctcctgcttgctctggctcccaggtaccagctgtgaacatcccaattcgacccagtctccatcctcctgtctgcgactctattggagacagacgtacaccatccacttggccgggcgagtcaggccatcagcgattcttagcctggttgcagcagaaaaaccgngggaccgacggccccctacgagactacgtagtcctagtggggtagccaactccaggtaacttcggacgtaaaggggtcgggtccccagtcccgtacggttccaggtcggctagtcggtaccacgttccgtagggaacctagtaactttaccacttctaccgaccgttataccgaggccacgtccctagaccgagtccctagaacgttattttcgacttaaattttattactgttacaacgtgtttaattacttaaccgttaacccctggttacgggaccgttttacgggcccgtaagggggaccctaaagggtaccgggaaagttacccggaaaccgtaaccggttggtacgggtcctaggtaaccc

SEQ ID NO: 216018 - DNA, 510 bp, Homo sapiens
  misc_feature: GYAE6OF02JIYP1.1.34.D01.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcaagaaaccagggcgagcccctnagatcgtagtctatggngcatccagattgcaaggtcgggtcccatccaggttcagtggcagtgcagtctgggacagattacactctacactatcagcacgctgcagcctgaagtattttcgactaattttatacgtgtacaactagtattataccgttacctagtcgtacgttcggcgtacgggacgaaggtaggtaacgtaccaacggtacgtgtcggtactcgaccg

SEQ ID NO: 216019 - DNA, 534 bp, Homo sapiens
  misc_feature: GYAE6OF02HJ0FY.1.34.D01.1.454.CMB.1.raw
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtcggggtcccatccaggttcagtggcagtgcatcgtgggacagattacactctcactatcagcagcctgcagcctagaagtattttgactaattttattacttgtacaactagttaattatacgtaccccttagtcggtacgttcggaccgaggggaaccgaaggtacggaacgtaccgaacgtacgtggtacggctacgaccaacctagttcgtacgttccttactacgttccctcccgtacc

SEQ ID NO: 216020 - DNA, 624 bp, Homo sapiens
  misc_feature: GYAE6OF02H3D7V.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatcttatggagacagagtcaccatcacttgccgggcagtcaggcatcagcgattcttagcctggttgcagcagaaaccagggcacggcccctnagatcgtagtctatggtgcaatccagattgacgaagggttcgggcccatccgaggttccagtggactagtcgcgtatcgtagggacagtacttaacacgtctactactactcaagcacgtccctgccgaacgtcccgtataaacggttattttacggtacctttaaatttttaacttaccttacgttaacctaaacttaaacgtttaattacttaaaccgtaacccccgttacgtacggggttacccgtttccggaccggtaaaccggggaccgttaaaggggtaacgggtaacgtaacccgttaaaaccggacgttaaccggttcgggtactacgtaaccccg

SEQ ID NO: 216021 - DNA, 601 bp, Homo sapiens
  misc_feature: GYAE6OF02FVC0R.1.34.D01.1.454.CMB.1.raw
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagtagtcaccatcacttgccgggnagtcaggccatcagcgattcttagcctggttcgcagcagaaaccgngggcgacgcccctcgagactcgtagtctatggtncatccagtcttgactagggtcggtcccatccaggttcaggtcgacagtcgctagtcgtagggacagtacttacactctactactatcacgtcacgtcctgcacgtctagtaacgtagttttacgacttaatttaacttacgttacgtaacctaacgttaacgttaactttaacgtaacggttacccctaacgggtttacggtaacggtttaccggtaccggtaacggggtaaccgtaacgggttacggaaaccgtacccgtaaccggtaccgttaggtacggtaccgtacgtaacccg

SEQ ID NO: 216022 - DNA, 516 bp, Homo sapiens
  misc_feature: GYAE6OF02JCA2F.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtaggtctatggtgcatccagattgcaaggtcggggtcccagtccaggttcagtggcagtgcatcgtggggacagtattacactctacactatcagcagcctgcagcctagaagtattttacgacttaatttacttactgtactaactaagtattataacgtaccctacgtggtaccgtcggccgaagggacctaaggtacggaagtccgaaccgacgtggtcggctgacc

SEQ ID NO: 216023 - DNA, 404 bp, Homo sapiens
  misc_feature: GYAE6OF02HK786.1.34.D01.1.454.CMB.1.raw
  modified_base (388)..(404): a, c, t, g, unknown or other
  misc_feature (388)..(404): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctacgtggacttcggccaggggaccaaggtggaatcaaccgaactgtggctgcaccagtctgtctcatccttccgcatctgaacgcaactcgtctgacgcgggcctggccaaaggccgctatagnnnnnnnnnnnnnnnnn

SEQ ID NO: 216024 - DNA, 799 bp, Homo sapiens
  misc_feature: GYAE6OF02H6717.1.34.D01.1.454.CMB.1.raw
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctatggagacagagtcaccatcacgttggccgggcgagtcaggccatcagcgtattcttagcctggttncagcagaaaccgagggcgacgcccctanagatcgtagtctagtggtgactataccgaagtagttaggacggtaacgggtcgggtaccctagttaccggaggtttacgaggtcggctaggtcgaccgtaagtcgtaacgggaactaacgtaacttaaccgtacctttactaaccttaaacttaacgtaccgaacgtaccgtaacggtcccgtaggtaacccgaacggtaccgttaaagggttaaaagtttacgttttaacgttaaaccttttaaagtttttaaccgttaaccgttaagttaaaccgtaaagtttaacggtttaaacttaaacccggtttacccggtttaaacccggttaacgggttacgggttaaaccccgggttaccggggaaacccggggtaaacgggggtaaaccgtaacgggtaaacgggtaaacccgtaaccggtaaaccggtaacggtttcgggaacgtacccggttaaccgtaaccttaacccggttacgtttaccgttaccggttttaccctaacccgtttaccccgtttaccccggtaccccgttaacc

SEQ ID NO: 216025 - DNA, 581 bp, Homo sapiens
  misc_feature: GYAE6OF02I2VY8.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctgtggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagactcgtagtctagtggtgcatccagattgcaaggtcggggtcccagtccaggttcaggtggcagtgcatcgtgggacagacttacactctcactatcagcagcctgcagcctagaacgtattttgacttaaattttacttacgttagttaccgtaaacttaggttaatttaacgttaaccgttacccccgttaggttcgggtaaccggtttccgggacccggtaagggggtaacccgtaaaggggttacggtaaacggtaccgaaacccggttaacggtacggtacgggcttaccgg

SEQ ID NO: 216026 - DNA, 572 bp, Homo sapiens
  misc_feature: GYAE6OF02JZZI4.1.34.D01.1.454.CMB.1.raw
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatcctcctgtctgcatctattgganacagagtcacatcacttgccggcagtcaggccatcagcgattcttagcctggttncagcagaacngggcagcccctnacgatcgtagtctagtcggtgcatccaggtattgacgtaagggtcggtacccagtcgacgttcgaggttcggcaggtcgctagtcgtgggacagtattacacgttcactaactagtacacgactacgccttgaccagtccgtagagtattttcggactaattttactatcgactaatacgttattacaccgttaccctaggtacggtaccgtttaccggcggtaaagggtaccgtaaagggttacggtaacgtaccggttaaacccggtaagtttcccggggaagtttcccgaggtaaccc

SEQ ID NO: 216027 - DNA, 532 bp, Homo sapiens
  misc_feature: GYAE6OF02IFA5C.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcagccccctnagatcgtagtctatggtncatccanattgcaagggtcgggtcccatccaggttcaggtggcagtgcatcgtgggacagtattacactctcactatcagcagcctgcagcctagaagtnttttgacttaatttattactgtacaatagttaattataccgttaccctagtacggtacgttccggccgtacggggaacccgaagggtacggtaacgtaccgaaaccggtaacgttggtacggtctagtacccg

SEQ ID NO: 216028 - DNA, 602 bp, Homo sapiens
  misc_feature: GYAE6OF02IOJ3G.1.34.D01.1.454.CMB.1.raw
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtctccatcctcctgtctgcatctagttggagacagagtcaccatcacttgccgggntagtcaggccatcagcgattcttagcctggttgcagcaagaaccngggcgacgcccctnagatcgtagtcatggtcgcatccgagtattcgacgtaaggtcgggtccaagtccgaggttcaggtggcagtgcagtcgtgggacaggattaccgactcgttacacttatcaggtacanccgtgacacgtccgtagaaacgtattttagaccttaaattttaacttacctacgtaactaacgtaagttaattttaactaaccgttaacccgttacgggtacgggttacccggtttacgggtccggtaacgggggaaccttaacggggtaacggtaacgtttacgaacccgttaaaccgtggttacggtaccgtgttaaccccg

SEQ ID NO: 216029 - DNA, 594 bp, Homo sapiens
  misc_feature: GYAE6OF02I0DG8.1.34.D01.1.454.CMB.1.raw
  modified_base (279)..(279): a, c, t, g, unknown or other
  misc_feature (279)..(279): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctatggtgcatccagtattgcaaggtcgggtcccatccgaggttcagtggcaggtgcatcgtgggaacagtacgttaccacgttctacaacttactcgaagccaacggcccttagcccgagtcccgttagaaacggttntttttacggacttaaagtttttaactttacgtaggttacctaaacgtagtttaaatttaacgtaccgttaaccccgttggtacggtacggtttaccggccgtaacgggggtacctaaggggtcggtaacgtaccgtaaccgtaacgtcggtacggccttacgaccg

SEQ ID NO: 216030 - DNA, 568 bp, Homo sapiens
  misc_feature: GYAE6OF02JJJY7.1.34.D01.1.454.CMB.1.raw
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcattctattggagacagagtcaccatcacttgccgggcagtcaggccatcagcgattcttagcctggttncagcagaaacagggcgacgcccctnagatcgtagtctatggtgcatccagtattgcaacggtgggtcccatccgaggttcagtggcagtgcatcgtgggacagattacatctacacttatcagcacgcctgccgtaagccgtagaacgttnttttacgacttaaattttacttaacgttaggttaccaaacgttagttaattacgttaacgttaccccttaaggttcggtaacgtttaccgggaccgtaaggggtaaccaaagggttggtaaacgtaccgaaaccggtaacgttaggtcggtactacggaaccc

SEQ ID NO: 216031 - DNA, 549 bp, Homo sapiens
  misc_feature: GYAE6OF02JXIQI.1.34.D01.1.454.CMB.1.raw
  modified_base (278)..(278): a, c, t, g, unknown or other
  misc_feature (278)..(278): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctagttggagacagagtcaccatcgacttgccgggcagtcaggccatcagcgattcttagctgttgcagcagaaaccagggcgacgcccctnagactcgtagtcctatggtgcatccagattgacaaggtgggtcccagtccgaggttccagtggcagtgcagtctgggacaggtatacgactctnactatcaagcagcctgcagcctagaagtntttgactaattttactactgttacaacgtagttaatttagtaacgttacccctaggttcgaaggtttccggacccgttaacggggacttaaaccgggtggaaacggttaccgaaacggtaaccgttggtacggggtccttaggacccg

SEQ ID NO: 216032 - DNA, 589 bp, Homo sapiens
  misc_feature: GYAE6OF02GICB8.1.34.D01.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccgagggcgacgcccctnagatcgtagtctagtggtgctactccagtattgacgtaaggggtcgggtacccatccgtaggtttcaggttcggcaggtgactagtcgtagggaacagtacttaccgacttcctacacttactcgacggcctaacggcctagacacgtacctaggaagttattttgaacttaatttcttaacgtgtaccaagttagttaattactaaccgttacccttacggtacggtccgttacgggaccggaacggggtaaccgaagggttacggaacgtacgaaccggtaacgtcggtacggtccgtgtaccc

SEQ ID NO: 216033 - DNA, 1066 bp, Homo sapiens
  misc_feature: GYAE6OF02HWFJM.1.34.D01.1.454.CMB.1.raw
tcagacgagtgcgtcacgaccggtgctcgatttagatcgtctgtgttggggtttgggggagtcgagacccctgtcaggacgactacgcgattcggactagtggagggtccccgctcaagtctaccctggggctccgtgctcgctcgtggttcgtcccagggtaccctaggttccttggtcgacattacctaattggacccgtagttcctccgattccgtacccgtgtcctagcgtagtcgtaacgttgggacggacgacgtaggttccaaccgacgttccggaaccgtttcggcccggggtcggaaggttcctaaggggtcccctaagttccgaaaccggtccggttaacggttttcccgttttaacggtcccgttaggggtttccgaccgtaacggaccgtaacggtaaaacccgtacgggggcccgtaaccggggtcccccccctacggaaacgggtaccgttacccgggttaaaggggttaaccgtttaacgggtccgggggttaggtaccggttaaccgttaccccggtaaagggtttaacgttttttaacgggaaccgggttaaacgggggggtttaccgggggttaaccccctaaagttttaccccgggtaaacggggtttaccgtaaacgggtttccggggaaccgtaacggggtttaccggacccgttaagtttacccggtaacgggggtaaccttaacgggttaaacctttaaaccggtaaccgtttaccctttttaacccgtaaaccgtttaaacgttaacccgtaaaccggtaccgttaaccgggttacccctttacggttaacccgtaaaacggtaccccgttaaaggtaaaaccggtttaccgttttttacgggaaccggtttaaacggtttttaaccgttaacccgttaaccgggttaccctaaacgttaacggtttttaatttaacgttaaccggttaaccccgttagggttacgggtttaaccggttaccgggaccggtaacggggtaccgtaagggttacgggaacgtaccgtaacggtacgttcggtacggtccggtacgtaacccgg

SEQ ID NO: 216034 - DNA, 545 bp, Homo sapiens
  misc_feature: GYAE6OF02JB6Y0.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggttgcagcagaaaccagggcgacgcccctacagactcgtagtctatggtgcatccagattgcaaggtcgggtcccatccgaggttcagtggcagtgcagtctgggacagtacttacactctacactatcagcagcctgcagcctagaacgtatttgacttaatttacttactcgtacaacgttagttattacgttacgtaccccgttagtacggtacgttccggaccggtaacggggaccgtaagggtacggaacggtaccgtaaaccggtacgttggtcggtactcgtaaccc

SEQ ID NO: 216035 - DNA, 710 bp, Homo sapiens
  misc_feature: GYAE6OF02H6J21.1.34.D01.1.454.CMB.1.raw
  modified_base (348)..(348): a, c, t, g, unknown or other
  misc_feature (348)..(348): n is a, c, g, or t
tcagacgagtgcgtcacgaccggtgctcgatttagatcgtctgtgttgggtttgggggtaggtcgagaccctgtcaggacacagcatggacatgagggtcccgctcagctctgggctcctgctgctctggcctccacggtaccagtctgtagacactaccaattcgacccagtcctaccacttccctcccgttgtcctgactacttcgttagttggagacaggatacaccacgtactacgttcggccggggactacgtacgacggaccagtacgacggctaagtttcttacgtccgttgggttcgactacggacaaacggaaaccggagggaccgaaccgccccctanacggtacttacgtaacgttctaagttcggcggtacaccgtacctaaggtacttcggaacggtaacggggttccgggacctaacgtccgtaggttaccgtaagggttcggactaggtcgactacgtcggtcgggaactaggtaaactttcgaactcgttaaccaacttacgtaacgacggaccaccgtacctcggaccgtacgtacgtaagtaacgtttatttactaaatttaacgtttacttacgtactaactaaacgttagttaacgtttaagtaacccgtacgttacggtacggtcggttaccgacggtacggagtaacggtaacgtacgtaccggaacgtagtacggacgtacacgacg

SEQ ID NO: 216036 - DNA, 390 bp, Homo sapiens
  misc_feature: GYAE6OF02FXAFL.1.34.D01.1.454.CMB.1.raw
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgacgcgggctggcaaggcgcatagnnnnnnn

SEQ ID NO: 216037 - DNA, 754 bp, Homo sapiens
  misc_feature: GYAE6OF02J39XF.1.34.D01.1.454.CMB.1.raw
  modified_base (722)..(722): a, c, t, g, unknown or other
  misc_feature (722)..(722): n is a, c, g, or t
  modified_base (734)..(734): a, c, t, g, unknown or other
  misc_feature (734)..(734): n is a, c, g, or t
tcagacgagtgcgtcacgaccggtgctcgatttagatcgtctgtgttgggtttgggcatggacatgacgggtccccgctcagctccgtgggctcctgctgctctcggctcccgaggtaccagctgtacactactactaacttcgaccctctcctcctctccctccgtgtctgacctatacgtagtacggacacgacgtactaccaccgtacgtccgtacggtcgggaccggtacgacgtaccgacggtactcgtacgtacgttcgttacttaccgttacggtcgtcggtacgacgacgaaccggaaaccggaaccggcggaccgtaccgtccgtacgtacgtacgttacgtacgtacgtacgtcgtacgtaactccgtaacggtaggtacggtacggtaacgggtccgggtaccgtaccgtacggttacggtacggttacgtagggtacgacgtggtaccgtacgttacggtacggaacgtactaacgttactacctcgtaactaccgtaacgtccgaacgctaccgtacgtcgtacgtacgtacccggttaagtaacgtttacttacttaacgttaatttaaccgtactacgtaacgttaaaccgtatttaccgtaacgttccggaaccggttacggtcgggttaccgacgaccgggtaacggtacggaacttacggaaccgtaccaggtactggtacgtacgcctacgtcctcgtttacncgttactacccnccgttacctaccgtcctacg

SEQ ID NO: 216038 - DNA, 520 bp, Homo sapiens
  misc_feature: GYAE6OF02HGIM2.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaaggtgggtcccatccaggttcagtcggcagtgcatcgtgggacagattacactctcactatcagcagcctgcagcctagatatttgcttaatttatactgtacaactagttattactacgttaccctaggttcgacgtttccggacgtaaggggacctaagggtcggaacgtaccgaaaccggtacgttcggtacggtcgtgacccg

SEQ ID NO: 216039 - DNA, 391 bp, Homo sapiens
  misc_feature: GYAE6OF02IMZ4J.1.34.D01.1.454.CMB.1.raw
  modified_base (378)..(378): a, c, t, g, unknown or other
  misc_feature (378)..(378): n is a, c, g, or t
  modified_base (383)..(391): a, c, t, g, unknown or other
  misc_feature (383)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatagtacccctacgtgacgttcggccaggggaccaaggtggaagtcaaccgatgtgctgcaccatctgtcttcatccttcccgcctctcacgcactcgtctgacgcgggctggcaaggccnatagnnnnnnnnn

SEQ ID NO: 216040 - DNA, 587 bp, Homo sapiens
  misc_feature: GYAE6OF02FZ0IK.1.34.D01.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctattggagacagagtcaccatcacttgccggngagtcaggccatcagcgattcttagcctggttgcagcagaaaccagggcgagcccctnagatcgtagtctatggtgcatccagtattgactaaggtcgggtcccatccgaggttcaggtcggcagtgcatcgtgggacagtacttacacttctactactatcagcagcctgcagtcctagaacgtattttcgacttaaagtttattaccgtagttaaccaaacgtagtttaacttaacgttaaccgttaaccccgttaggttcgggtaaccggtttaccgggacccggaaacgggggttacccgtaaaggggttcggaaacgttaccgaaacccggtaacgttagggtacgggtactacggtaacccg

SEQ ID NO: 216041 - DNA, 508 bp, Homo sapiens
  misc_feature: GYAE6OF02H5WOE.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccagggcagcccctnagatcgtagtctatggtgcatccagattgcaaggtgggtcccatccaggttcagtggcagtgcatcgtgggacagtattacactctcacttatcagcagctgcagctgaagtatttgctaattttatacttagtacaactagtaattatacgtaccctagtcggtacgttcggcgacgggtaccaagggtacgaacgtcgaaccgtaacgtggtagccgtgtacccg

SEQ ID NO: 216042 - DNA, 506 bp, Homo sapiens
  misc_feature: GYAE6OF02HCT2B.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctgaagtatttgctaatttatactgtcaacagttattatacgtaccctagtcggtacgttcggccgaggggtacctaagggtacgaagtcctaaccggaacgttggtcggtactgtaccg

SEQ ID NO: 216043 - DNA, 606 bp, Homo sapiens
  misc_feature: GYAE6OF02GC2F7.1.34.D01.1.454.CMB.1.raw
  modified_base (267)..(267): a, c, t, g, unknown or other
  misc_feature (267)..(267): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccgngggcgacgcccctcagatcgtagtctagtggtncatccagtattgacgaaggtcgggtacccagtccgaggttcaggtcggcagtgactatcgtgggaacagtacttacgactctcaactatcagactcgcctgacacgtacctagtaagtattttcgacttaaacgtttacttacgtctaactaaaccgtagtttaacttaaccttaacgggttaacccccttagggttacggtaaccggttcgggtaacccggtaacgggggtaacccggtaaagggttaccggtaaagttccccggaaaccgttaaccggttgggttaccgacgtacggtaacccg

SEQ ID NO: 216044 - DNA, 536 bp, Homo sapiens
  misc_feature: GYAE6OF02HOI21.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcagcccctnagatcgtagtctatggtgcatccagattgcaagggtcgggtcccatccaggttcagtggcagtgctagtctgggacagattacactctcactatcagcacgcctgcagccttagaagtattttgacttaatttacttactgtactaacttagttaattaactaacgttaccctagttcggaccgtttcgggaccgtaacggggacctaagggtacggaacggtccgaaaccggtaaccgttggtacggtctagaccg

SEQ ID NO: 216045 - DNA, 519 bp, Homo sapiens
  misc_feature: GYAE6OF02JB7XK.1.34.D01.1.454.CMB.1.raw
  modified_base (280)..(280): a, c, t, g, unknown or other
  misc_feature (280)..(280): n is a, c, g, or t
  modified_base (505)..(505): a, c, t, g, unknown or other
  misc_feature (505)..(505): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcgaaggtgggtcccatccaggttcagtggcagtgcatcgtgggacagattacactctcactatcagcacgcctgcagccgtagtaagtattttacgacttaattttacttaacttgtactaactagttaattactacgtacccttagtcggacttcggcgtaagggacctaaggtaggaacgtacaaccggttacnggtacggctagacc

SEQ ID NO: 216046 - DNA, 489 bp, Homo sapiens
  misc_feature: GYAE6OF02FZCD8.1.34.D01.1.454.CMB.1.raw
  modified_base (104)..(104): a, c, t, g, unknown or other
  misc_feature (104)..(104): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
tcagacgagtgcgtcacgaccggtgctcgatttagatcgtctgtgttgggtttgggggagtcagacccctgtcaggacacagcatggacatgagggtcccccgntcagcccctgggcgtcctgctgctctggctcccacggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatcagattgcaaggtggggtcccatccaggttcagtggcagtgcatctgggacagattacactctnactatcagcagccngcagcctgagatttgcaattttattactgtacaatagttattatacgtacccctagtggacgttcgaccgnggggacaaggtgagacacgactggngctgctaccg

SEQ ID NO: 216047 - DNA, 491 bp, Homo sapiens
  misc_feature: GYAE6OF02GYMBW.1.34.D01.1.454.CMB.1.raw
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctagaatatttgactaatttattactgtacaaactagttattatacgttacccctagtcggtacgttcggaccgagggaccaaggtagaacgtcaccgatgtggctgccacntctgtctacnctcctccgc

SEQ ID NO: 216048 - DNA, 514 bp, Homo sapiens
  misc_feature: GYAE6OF02JHQ57.1.34.D01.1.454.CMB.1.raw
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
  modified_base (376)..(376): a, c, t, g, unknown or other
  misc_feature (376)..(376): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattcttagcctggttgcagcagaaccagggcagcccctnagatcgtagtctagtggtgcatccagattgcaaggtcgggtcccatccaggttcagtggcagtgcatcgtgggacagtattacactctacactatcgancagcctgcagcctagaagtatttgacttaatttatactgtactaactagttaattactacgttacccctaggtcgtacgtcggaccggtacgggaacctaaggtacggaagtaccacggtaactggtcgtcgtgaccc

SEQ ID NO: 216049 - DNA, 500 bp, Homo sapiens
  misc_feature: GYAE6OF02GZ2LF.1.34.D01.1.454.CMB.1.raw
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
tcagacgagtgcgtcacgaccggtgctcgatttagatcgtctgtgttgggtttgggagtcaggccatctagcgattctttagacctggttgcagcagaaaccagggcgagcccctcagagtcgtagtctatggtgcgatccagattgcaaggtgggtcccatccaggttcagtggcagtgcatctgggacagattacgactctcactatcgagcagcctgcagcctgaagtattttgcgtaatttattacctgtacaactagttattatacgtaccccgtaggtcggtacgttcggccaggggaccaaggtgaaacgtcaaccgaatgtcggactagcacatctagtcttcatcttccgctatctagacgcactcgtctgacgcggactggactaaggcgacaagtagcagtcgntacgttgctgtncgnganagagngnctcgtctcgtcacacacgcgcncgtcgtcgtcncgcgcncncgcgcgcgcgacgcgagcg

SEQ ID NO: 216050 - DNA, 633 bp, Homo sapiens
  misc_feature: GYAE6OF02IC71U.1.34.D01.1.454.CMB.1.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattganacagagtcaccatcacttgctggcgagtcaggccatcagcgtaattcttagcctggttgcagcagaaaccagggcgacgcccctnagatcgtagtcgtatggtgcatccgagattgacgaaggtcggggtacccagtcccgaaggtttccaaggttcgggactagtcggcaagttcgtagggacagtaacgttactaccgtctacacttactcacggtctcgaccgtgcctagtcccgtagtaacggttattttcgactttaaacttttattaccgttagtaacctaaacttaagttaacgtttaacttaaccgttaccccgttagttacggggttaaccgttcggggtaccccggtaacgggggtaaccgtaacggggttaacgggtaacggttaacccgtaaaccggtaacggttacggtaccgggtccgtaacgg

SEQ ID NO: 216051 - DNA, 522 bp, Homo sapiens
  misc_feature: GYAE6OF02G1HKM.1.34.D01.1.454.CMB.1.raw
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcagtcaggccatcagcgattctttagcctggttncagcaagaaaccagggcgagcccctnagatcgtagtctatggtgcatccagattgacaagggtcgggtcccatccgaggttcaggtggcagtgacatcgtgggaacagaacttacacttctacactatcagcagcctgcagcctagaatntttnacttaatttattactgtactaatattaattataccgtaccctaggtagtaccgttcggccgacgggaaccgaaggtacggaagtaccgaaccgaacgttggtcggctgaccg

SEQ ID NO: 216052 - DNA, 400 bp, Homo sapiens
  misc_feature: GYAE6OF02HW1FC.1.34.D01.1.454.CMB.1.raw
  modified_base (349)..(349): a, c, t, g, unknown or other
  misc_feature (349)..(349): n is a, c, g, or t
  modified_base (381)..(400): a, c, t, g, unknown or other
  misc_feature (381)..(400): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgctaaggtgggtcccatccaggttcagtggcagtgcatctgggacagattacactctcactatcagcagcctgcagcctgaagattttgcaatttattactgtcaacagttattatagtacccctagtggacgttcggccaggggaccaaggtggaagtcaacgactgtggctgcaccatctgtcttcatcttcccgcatctgaacncactcgctgagcgggctggcaaggcgcaatgnnnnnnnnnnnnnnnnnnnn

SEQ ID NO: 216053 - DNA, 506 bp, Homo sapiens
  misc_feature: GYAE6OF02FYLZ3.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtcgggtcccatccaggttcagtggcagtgcatctgggacagattacactctcactatcagcagcctgcagcctgaagtattttgacttaatttattactgtacaactagttattactacgtaccctagtggtacgttcggccgaggggacctaaggttacggaagtcaaccgacgttggtcggtctgtacc

SEQ ID NO: 216054 - DNA, 588 bp, Homo sapiens
  misc_feature: GYAE6OF02F4EXF.1.34.D01.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattgganacagagtcaccatccacttggccgggcgagtcaggccatcagcgattcttagcctggttgcagcagaaaccagggcgacgcccctnagatcgtagtctagtggtgcatccagtattgacgtaagggtcgggtcccagtccaggttcaggtggcagtgcatcgtagggacagtacttacactctctaactatcagcacgcctgacagcctagaagttnttttcggacttaaattttacttacgttagtaacctaaacttagttaactttactaaccgttaccccgttaggttcgggtaaccggttccgggaaccggtaacgggggaaccgtaagggtaggaaaccgttacccgaaaccgggtaacttcgggtacggtaccgtaggtacccg

SEQ ID NO: 216055 - DNA, 537 bp, Homo sapiens
  misc_feature: GYAE6OF02HQ819.1.34.D01.1.454.CMB.1.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctatggagacagagtcaccatcacttggccgggcgagtcaggccatcagcgtattctttagcctggttgcagcagaaccagggcacgcccctnagactcgtagtctagtggtncatccagtnttcgacaagggtcggtcccatccgaggttcagtgctagtgcatcgngggacagatacnctctcatatcagcagcctgcagccttagaagttattttcgacttaagtttactacgtgtacaagtagttacttataaccgttaccctaggtcgtacggtttccggacggaacgggtaccaagggttacggaacgtaccgaaccggtaagttcggtacggtctagtaccc

SEQ ID NO: 216056 - DNA, 576 bp, Homo sapiens
  misc_feature: GYAE6OF02JGL8H.1.34.D01.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatccagcgatttctttagcctggttgcagcagaaacccagggcgacgcccctnagatcgtagtctatggtncatccagnttgcaagggtcgggtacccatccgaggttcaggtggctagtgcatcgtagggacagtacttacactcactactatcagcacgcctgcagcctagaagttatttcgacttaaattttacttactacgttaacaactagttaacttacgtaaccgttaccccttaggtacggttaccggttccggtaaccggtaacggggtaaccgtaaggggtacggtaaacggttaccgaaaccggtaagttcgggtaggtccgtacggtaaccc

SEQ ID NO: 216057 - DNA, 485 bp, Homo sapiens
  misc_feature: GYAE6OF02FHN5S.1.34.D01.1.454.CMB.1.raw
  modified_base (281)..(281): a, c, t, g, unknown or other
  misc_feature (281)..(281): n is a, c, g, or t
  modified_base (392)..(392): a, c, t, g, unknown or other
  misc_feature (392)..(392): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatctgggacagattacactctcactatcagcagcctgcagcctgaatntttgctaatttattactgtacaactagtattatacgtaccctagtgacgttcggcgagggaccaaggtgaagtcaacgtactgtcggctgacc

SEQ ID NO: 216058 - DNA, 497 bp, Homo sapiens
  misc_feature: GYAE6OF02JBKYH.1.34.D01.1.454.CMB.1.raw
  modified_base (279)..(279): a, c, t, g, unknown or other
  misc_feature (279)..(279): n is a, c, g, or t
  modified_base (383)..(383): a, c, t, g, unknown or other
  misc_feature (383)..(383): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgagcccctnagatcgtagtctagtggtgcatccagattgacgaagggtcgggtcccatccgaggttcaggtggcagtgctagtcgtagggacagtattacactctcatatcancagcctgcacgctggaagttatttgacttaatttatactntacaactatattanacgtaccctagtgtacgtcggcgtaggactaaggngaatcgaactagtgcggtcngtacc

SEQ ID NO: 216059 - DNA, 494 bp, Homo sapiens
  misc_feature: GYAE6OF02GS06R.1.34.D01.1.454.CMB.1.raw
  modified_base (279)..(279): a, c, t, g, unknown or other
  misc_feature (279)..(279): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcagcccctnagatcgtagtctatggtgcatccagattgcaaggtcgggtcccatccaggttcagtggcagtgcatctgggacagattacactctcactatcagcagcctgcagcctgaatntttgctaatttatactgtacaactagtattatacgtaccctagtcgtacgttcggcctaaggggacctaagggtggaagtacaaccggtatcggtggctgacc

SEQ ID NO: 216060 - DNA, 519 bp, Homo sapiens
  misc_feature: GYAE6OF02IF0O8.1.34.D01.1.454.CMB.1.raw
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatccagattgacaaggtcgggtcccatccaggttcagtggcagtncatcgtgggacagtattacactctcactatcagcagcctgcagcctagaagtntttgactaatttattactgtacaactagttaattactaaccgtaccctagtcggtaccgttcgggaccgtaaggggaccaagggtacgaacgtccgaaccggagtggtcggtcctagacc

SEQ ID NO: 216061 - DNA, 544 bp, Homo sapiens
  misc_feature: GYAE6OF02GKUFX.1.34.D01.1.454.CMB.1.raw
  modified_base (282)..(282): a, c, t, g, unknown or other
  misc_feature (282)..(282): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagccccctnagatcgtagtctatggtgcatccagattgcaagggtgggtcccagtccaggttcagtggcagtgcatcgtgggacagattacactctcactatcagcagcctgcagcctagaagtnttttaggacttaatttacttactgttacaactaagttaattaagtaaccgttacccgttacgtcggtaccgtttacgggccgtaacggggtacctaagggtacggaacgtaccgtaaccggtaacgttggtacggtctagtacccg

SEQ ID NO: 216062 - DNA, 682 bp, Homo sapiens
  misc_feature: GYAE6OF02JWT2X.1.34.D01.1.454.CMB.1.raw
  modified_base (130)..(130): a, c, t, g, unknown or other
  misc_feature (130)..(130): n is a, c, g, or t
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (184)..(184): a, c, t, g, unknown or other
  misc_feature (184)..(184): n is a, c, g, or t
  modified_base (579)..(579): a, c, t, g, unknown or other
  misc_feature (579)..(579): n is a, c, g, or t
  modified_base (645)..(645): a, c, t, g, unknown or other
  misc_feature (645)..(645): n is a, c, g, or t
tcagacgagtgcgtcacgaccggtgctcgatttagatcgtctgtgttgggtttgggggtaggtcgtagaccctgtcaggacacagcatggacatgagggtcccgctcagctccgtgggctcctgctgctntgctccaggtccngctgtgacntccattgacccagtctccatccctccctgtcncgtcactctattgggacacgagtagtccacctatcactttggccggggcgaattccgacggtaccattacgacgcgtagttcttttacgtaccttggttcgtactacgtaccaacggtaaaccgagggtacgaccgccccgtacgtagtaaccgtacgtacggttacgtagtcggttacgacgtactaccgtacgtaacgttcgtcgtaaacgggtcgggttacccaacgtcgtaacggttaccgagtcgggacgtaggacgtcgtacgtacggtgggaaccaggtacttacgtactcgttcaaccgtatcgggactacgcgtacctgactcacgtacttaagtactttagtacttagttaacttacgttcgaacttaacgttaagttacttaanacccgtttaacctacggtaggttaccttacgggtcggtaacgggtaacgtaacggttacggtaacncgggttaaaccaggttaggtaccggttgacgttaccg

SEQ ID NO: 216063 - DNA, 543 bp, Homo sapiens
  misc_feature: GYAE6OF02GQB0K.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctcagatcgtagtctagtggtgcatccagattgacgaagggtcgggtccatccgtaggttcgaggtggcagtgctagtcgtgggacagtacttacactctactactatcagcacgcctgacagtcctagaagttattttcgacttaatttatactgtacaactagttactactaacgtacccgtagtcggtacgttcggaccgtacggggaacgtaagggtacggaacgtacgaaccggtaagttcggacggtcctagtacccg

SEQ ID NO: 216064 - DNA, 447 bp, Homo sapiens
  misc_feature: GYAE6OF02G4ZA3.1.34.D01.1.454.CMB.1.raw
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (416)..(447): a, c, t, g, unknown or other
  misc_feature (416)..(447): n is a, c, g, or t
tcagacgagtgcgtcacgaccggtgctcgatttagatcgtctgtgttgggtttgggtagtcaggccatcagcgattctttagcctggttgcagcagaaaccaggcgagcccctcagatcgtagtctatggtgcatccagattgcaaggtggggtcccatccaggttcagtggcagtgcatctgggacagattacactctcactatcagcagcctgcagcctgaagattttgcaattttatacngtacaacagtatttatcgtacccctagtgacttcgccagggcaaggtgaagtcaaaccgactgtgctgcacaatntgtctnatccttaccgccatcgttcgaaaccgctaaccgttcgtgcgtaaggccggggttcacgggtnaacgggcgtnaaacgttagcgtancngacnnnnnnnnnnnnnnnnnnnnnnnnnnnnnnnn

SEQ ID NO: 216065 - DNA, 556 bp, Homo sapiens
  misc_feature: GYAE6OF02H4LA2.1.34.D01.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (351)..(351): a, c, t, g, unknown or other
  misc_feature (351)..(351): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggttncagcagaaccngggcagcccctnagatcgtagtctatggtgcatccagattgcgaagggtcgggtcccagtccaggttcaggtggcagtgcatcgngggacagattacactctacactatcagcagcctgcagcctagtaacgtattttacgacttaaattttacttaactgtaacaactagttaattaacttaacgtaccccttagttcggtaccgtttcgggacccgtaacgggggtacccaaagggttcggaaacgttacccgaaaccggtaacgttgggtacggtaccgtgtaaccg

SEQ ID NO: 216066 - DNA, 647 bp, Homo sapiens
  misc_feature: GYAE6OF02GESGR.1.34.D01.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgattcttagcctggtcncagcagaaaccgngggcgacgcccctnagtatcgtagtctagtggtgcatccagtattgacgtaaggggttcggggtacccctagttacccgagggtttacaaggttcggcgtaggtcgacgtacgttcggtacggggaactaggtaactttaaccaccttactacctaacttactcgaacgtacctacgcccgttaggcctacggtcccttagaagtttactttttagaactttaaattttacttacgttcgtaactaacgttaagtttaactttaacgttaacccgttacccgttaggttacggtaccggttaccgggaccggaacggggtaaccgtaaaggggtcgtaacggttacgaaccggtacgttcggtcggtaccgtacgtaccc

SEQ ID NO: 216067 - DNA, 400 bp, Homo sapiens
  misc_feature: GYAE6OF02JEP76.1.34.D01.1.454.CMB.1.raw
  modified_base (382)..(382): a, c, t, g, unknown or other
  misc_feature (382)..(382): n is a, c, g, or t
  modified_base (388)..(400): a, c, t, g, unknown or other
  misc_feature (388)..(400): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtacaacagttattatacgtacccctagtggacgttcggccaggggaccaaggtggaagtcaaccgaactgtgctgcacatctgtctcatccttccgcatcagaacgcactcgtctgacgcgggctgggcaaggcncatagnnnnnnnnnnnnn

SEQ ID NO: 216068 - DNA, 533 bp, Homo sapiens
  misc_feature: GYAE6OF02F0V06.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgcgtaagggtcggggtcccagtccgaggtttcaggtggcagtgcatcgtgggacagattacactctacactatcagcagcctgcagcctagaagtattttgacttaaatttattacgttagtacaactagttaattaacgtacgttaacccctagttcggtacgttcgggcgaacgggactaagggtaggaacgtacgaacggtaaccgtggtacggctgacc

SEQ ID NO: 216069 - DNA, 510 bp, Homo sapiens
  misc_feature: GYAE6OF02GQ87R.1.34.D01.1.454.CMB.1.raw
  modified_base (280)..(280): a, c, t, g, unknown or other
  misc_feature (280)..(280): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaaggtcgggtcccatccaggttcagtggcagtgcatcgtgggacagtattacactctcactatcagcacgcctgcagcctagagtntttgacttaatttatactgtacaatagttattatacgtaccctagtcggtacgttcggacgtaaggggacctaagggtacgtaagtaccgaaccggtacgttggtcggctgacc

SEQ ID NO: 216070 - DNA, 545 bp, Homo sapiens
  misc_feature: GYAE6OF02GBVNL.1.34.D01.1.454.CMB.1.raw
  modified_base (281)..(281): a, c, t, g, unknown or other
  misc_feature (281)..(281): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaaggtcgggtcccatccgaggttcaggtggcagtgctatcgtgggacagtattacactctacactatcagcacgcctgcagcctagaagtattttgacttaattttacttacgttntactaactagttaattactaaccgttaccccgtacggttggtaccggttcgggacccggtaaggggaacctaagggtacggaacgtaccgaaccgtacgtggtcggactgtaacccg

SEQ ID NO: 216071 - DNA, 387 bp, Homo sapiens
  misc_feature: GYAE6OF02HQ7QE.1.34.D01.1.454.CMB.1.raw
  modified_base (382)..(387): a, c, t, g, unknown or other
  misc_feature (382)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccgcatctgaacgcactcgtctgagcgggctggcaaggcgcatagnnnnnn

SEQ ID NO: 216072 - DNA, 519 bp, Homo sapiens
  misc_feature: GYAE6OF02JZSK9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcagaaaccagggcgacgcccctcagatcgtagtctatggtgcatccagattgacgtaagggtcgggtcccagtccgaggttcaggtcggcagtgcatcgtagggacagtacttacactctacactatcagcagcctgctacgcctagtaagtatttgacttaatttattactgtacaatgttatatacgtaccctagtggtacgttcggccgtacgggacgtaaggtacggaagtaccgaacgacgtggtcggtactgtacc

SEQ ID NO: 216073 - DNA, 610 bp, Homo sapiens
  misc_feature: GYAE6OF02IYAPT.1.34.D01.1.454.CMB.1.raw
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggnagtcaggccatcagcgattcttagcctggttgcagcaagaaaccgngggcgacgcccctanagactcgtagtctaagtggtgcatccagtattggcgaagggtcgggtcccatccgtaggttcaaggtggcagtgctatcggtagggaactagatttaaccgacttctacacttagtcaggccaggtccctgacgacgtccttaggaaagttctttttacggacttaaacgtttttataccgttagtacctaaaaccgttagtttaactttaacgtaacccgttaaccccgtaggtaccgggtacgttaccgggaccggaacgggtaccgaaaggggttacgaaacggtaacccgtaaccggtaacgttggtacggtcttaggaccc

SEQ ID NO: 216074 - DNA, 488 bp, Homo sapiens
  misc_feature: GYAE6OF02GI0N9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgactaatttattactgtacaactagttattatacgtaccctagtgacgttcggcctagggacaaggtgagtcgaacgacgtgtgtctgacc

SEQ ID NO: 216075 - DNA, 578 bp, Homo sapiens
  misc_feature: GYAE6OF02GCM09.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcacatcacttgccgggnagtcaggccatcagcgtattctttagcctggttgcagcaagaaccgngggcgacgcccctnagatcgtagtctagtggtgacatccagtacttggacgagggtcgggtccccatccgaggttcaggtgcgagtgcatcgtgggacagtattacactctcactancacgacacggctgcacgcctagaacgttnttttgactttaattttacttacgttagtaacctaagttaagttaactttaacgtaacgtttaccccgttacggttacggtaccggtttaccggaaccggacggggtaaccgtaagggttacgaacggttaccgaaaccggtaacgtggtccggtactagacccg

SEQ ID NO: 216076 - DNA, 393 bp, Homo sapiens
  misc_feature: GYAE6OF02FG1IB.1.34.D01.1.454.CMB.1.raw
  modified_base (383)..(393): a, c, t, g, unknown or other
  misc_feature (383)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcggccagggggaccaaggtggaagtcaaccgaactgtggctgcaccatctgtcttcatcttccgcatctgaacgcactcgtctgacgcgggctggcaaggcgcatagnnnnnnnnnnn

SEQ ID NO: 216077 - DNA, 591 bp, Homo sapiens
  misc_feature: GYAE6OF02JXZMH.1.34.D01.1.454.CMB.1.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (417)..(417): a, c, t, g, unknown or other
  misc_feature (417)..(417): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagacgagtgcgtcacgaccggtgctcgatttagatcgtctgtgttgggtttgggggtagtcagaccctgtcaggacacagcatggacatgagggtccccgctcagctcctgggctcctgctgctctggctcccaggtaccagctgtgacatccaattcgacccagtctccatccctccctgtctgactatctattgganacagagtcaccatcacttggccgggacgagtcagggccatcgagcgattcttacgctggttgccagtacaacgaaaccgnggggccacgcccctcagatcgtacgtntagtggtgcatccagtattggacgtaaggggtcgggtaccctagtcccgtaggttaccgaggtcggactagtcgactagtcgtgggacagtactactactctctaactntcaagccacgcctacgacacgccgttaagacttntttacgacttaaattttacncgttacgtactaatagtttaatacttaacgtacccttaggtacggtacggttaccggacggtaccggtaacgagttacgggaacttacggaacgtacggtagtacgggtcctagtacccg

SEQ ID NO: 216078 - DNA, 573 bp, Homo sapiens
  misc_feature: GYAE6OF02HX78E.1.34.D01.1.454.CMB.1.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (416)..(416): a, c, t, g, unknown or other
  misc_feature (416)..(416): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcattgccgggcagtcaggccatcagcgtattctttagctggttgcagcaagaaccagggcgacgcccctnagatcgtagtctatggngcatccagtattgacgtaagggtcgggtacccagtccaggttacgaggtggcgtaggtcgcgtaagtcgtagggacaggtattacactctacactatcagcagctgctacgctagaagtnttttaggacttaaattttactaacttgtaactaacttagttaacttaacgttaacgttaccccgttaggttacgggtacgtttccggaaccggtaacggggtaacctaagggtacggtaacgtaccgaaaccggtaacggtggtacggcgtgtaacc

SEQ ID NO: 216079 - DNA, 531 bp, Homo sapiens
  misc_feature: GYAE6OF02H8X8G.1.34.D01.1.454.CMB.1.raw
  modified_base (279)..(279): a, c, t, g, unknown or other
  misc_feature (279)..(279): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaccagggcgagcccctnagatcgtagtctatggtgcatccagattggacgtaagggtcgggtaccccagtccgaggttcaggtcggacngtncatcgtagggacagtattacgactctcactatcacgcagcctgcacgcgtagaagtntttagacttaaatttattactgtacaactagttattactacgttaccctagtcggtaccgttcggccgtagggtaccaagggtagaacgtacaaccggtacgtacggtcggtactgtacc

SEQ ID NO: 216080 - DNA, 963 bp, Homo sapiens
  misc_feature: GYAE6OF02FLDF6.1.34.D01.1.454.CMB.1.raw
tcagacgagtgcgtcacgaccggtgctcgatttagatcgtctgtgttggggttgggggagtcacgaccctgtcaggacacgaggtctactggtacgatgacgggtccccgctccaggacctccgtggggctcctgcctgtcgtcgttgggccttcccgaaggttaccgttcgcgttggtcgtaccttaagtacccgtaaagtttccgaaccccgtaggttcctacccgtattcccctaccccttggttccgtggcctagggttcgtagttagggacgaacgacggtacgggtaccaaccataccgaacgttcggcccggggcgtagtccgacggccactccgaggtccgtactttcttaggtccgtggttcgcagcgaacgaaaccggtcggggcccaaccgtaccccgtacgaaggacgtacggtagttcggtaggtgggtcgactagttccgtagtagttcggacggtaacgggggttccgggtaaccctaggttaccgtaagggtttcgaacgggttcggaccgtaaggtccgtaccgtaacggtaccgggtacgggtaactacggtaactttaaccgaccttccgtaacgtaaacgttaactaccgtaaccggtaccgtaaaccggtcccgtaggtaccgttaacggtaccggttaaggtaaacgtttacgttttaccggaaacttttaaaccgtttttaacgttaaccgttagggttaaaccgaaacggtttacggtttaaaccgttttaacgtaaaccccgtttaaccccgggtttaacggggttaaccggggttaacccggggggttaacccgggggaaaccccgggtaacgggggggtaaaccccgggttaaacgggggttaacccggttaaaacccggggttaacccgttaaacccggggttaaaccgggttccggggtttaaccggggtacccgggttaccgggtaaccccgg

SEQ ID NO: 216081 - DNA, 524 bp, Homo sapiens
  misc_feature: GYAE6OF02GKVFW.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccgngggcacgcccctcagatcgtagtctatggtgcatccagattgcgaagggtgggtacccatccgaggttcagtggcagtgcatcgtgggacagattacactctacactatcagccacgcctagccagccgtagaagtattttcgacttaaatttacttactgtacaactagtaattactacgtaccctagtcggacgttcggaccgtaggggacctaaggtcgaagtaccgaaccgtaacgtcggtcggactgaccc

SEQ ID NO: 216082 - DNA, 692 bp, Homo sapiens
  misc_feature: GYAE6OF02HWV7I.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgtattctttagcctggttgcagcagaaaccagggcgacgcccctnagatcgtagtctagtggtgcatccagattggacgtaagggttcgggtccccagtccgtagggttcaaggttcggacctaggtcgactagttccggtaggggaacctaaggtactttaaccgacctttccttactaaccttaagtccgaacgaccgacggtcccttaggaccgtacgtacccgttaaggtaaacgttattttttacggactttaaagtttttaacgttaaccgttacggttaacctaaacgttaagtttaaactttaaacgttaaacccggttaccccgttaaggttacgggtacccggtttaccgggaacccggtaacgggggtaaccctaaaggggttaaccggtaaaccggtacccgaaaacccggtacgttacgggtacggtaccgtacggtaacccg

SEQ ID NO: 216083 - DNA, 390 bp, Homo sapiens
  misc_feature: GYAE6OF02GS0XB.1.34.D01.1.454.CMB.1.raw
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccaccctctcacgcactcgtctgagcgggctggcaaggcgcatagnnnnnnn

SEQ ID NO: 216084 - DNA, 523 bp, Homo sapiens
  misc_feature: GYAE6OF02IGURP.1.34.D01.1.454.CMB.1.raw
  modified_base (299)..(299): a, c, t, g, unknown or other
  misc_feature (299)..(299): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtncatccagattgcaaggtgggtcccatccaggttcagtggcagtgcatcgtgggacagattcactctcactatcagcagcctgcagcctagaatnttttagcttaaattttattactgtacaactagttacttatacgtacccttagtaggtaccgttcggaccgtaggggacctaagggtacggaacgtccgaaaccggtaacgttcggtacggcctaggaccc

SEQ ID NO: 216085 - DNA, 558 bp, Homo sapiens
  misc_feature: GYAE6OF02HGBOL.1.34.D01.1.454.CMB.1.raw
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttggccgggcagtcaggccatcagcgattcttagcctggttncagcaagaaccagggcagcccctnagatcgtagtctagtggtgcatccagtattggacgaagggtcgggtacccagtccgtaggttcaggtggcagtgctagtcgtagggacagtacttacactctcactatcagcagcctggcagcctagaagtntttagacttaaagtttactagtgtaactaacgtagttaacttaactaccgttacccgtacggttacggtaacggtttccggaaccgtaaggggtaaccctaagggtacgtaacgtaccgaaccgtacgttaggacggtcgagtacccg

SEQ ID NO: 216086 - DNA, 560 bp, Homo sapiens
  misc_feature: GYAE6OF02HHHWK.1.34.D01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggnagtcaggccatcagcgattcttagcctggttgcagcagaaaccagggcgagcccctnagatcgtagtctatggtgcatccagtattgactaagggtcgggtcccatccgaggttcaggtggcagtgctagtcgtagggacagtacttacactctacacttatcagcagcctgacagcctagaagtnttttacggacttaattttactacgtgtaccaaacgtagtttaattacgtaacgtacccttacggtacggtacgtttcccgggacgtacggggaaccctaagggtacggaacgtaccgtaaaccggtacgtacgggtacggtcctacggtacc

SEQ ID NO: 216087 - DNA, 502 bp, Homo sapiens
  misc_feature: GYAE6OF02GHBX9.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctnagatcgtagtctatggtgcatccagattgcaaggtgggtcccatccaggttcaggtggcagtgcatcgtgggacagattacactctcactatcagcagcctgcagcctgaagtattttgacttaatttattactgtacaactagttattatacgtaccctagtggtacgttcggaccgagggaccaaggtggaacgtcgaaccgtagtggtcggctgaccg

SEQ ID NO: 216088 - DNA, 610 bp, Homo sapiens
  misc_feature: GYAE6OF02HPOYB.1.34.D01.1.454.CMB.1.raw
  modified_base (283)..(283): a, c, t, g, unknown or other
  misc_feature (283)..(283): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagacgagtgcgtcacgaccggtgctcgatttagatcgtctgtgttgggtttgggggagtcagaccctgtcaggacacagcatggacatgagggtccccgctcggctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctnagatcgtagtctatggtgcatccagattgcgaaggtcgggtcccagtcctaggttcaggtgcagtgcatcgtggacagtatacnctctcactancagcagcctagcacgtcctaggtaaagttcttttagacctttaaattttactttaactagttaaacgtaaaaagttattttaaacgttaaccgttaaccccgttaagggttacgggtacccggtttaccgggaacccggtaacggggggtaaccctaaaggggttacgggaaaccgttaccgaaacccggtaacgttggggtaccggtaccgttacggacccgtaaccctacg

SEQ ID NO: 216089 - DNA, 703 bp, Homo sapiens
  misc_feature: GYAE6OF02H9Z2L.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcagtcaggccatcagcgattctttagcctggttgcagcagaaaccngggcgagcccctnagatcgtagtctatggtgcatccagtattgacgtaaggtcgggtcccagtccgaggttccaggtcggactgtgcagtcgtaggggaacctaaggtactttaaccgaccttccgttacaaccttaagttacccgaaggtaccctaacggtcccttaggacccgtacggtacccgttaagtaaacggtttagtttttacgaaccttttaaaattttacgtttaccttaggttaacctaaacgttaagtttaactttaaagtaacccgtttaacccccgttagggttaccgggttaaccgggttttacccgggaccggttaaaccgggggggaacccgttaaacggggttacgggtaaacccggtttacccgaaaaccccgggttaacgtttacggggtaacgggttacccgtacggtaaccccg

SEQ ID NO: 216090 - DNA, 580 bp, Homo sapiens
  misc_feature: GYAE6OF02HT17A.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctagtggtgcatccagattgctaagggtcgggtcccagtccaggttcaggtggcagtgcatcgtgggacagtactacactctacactatcacgcagcctggcagcctagaagtatttgacttaatttacttacttcgtaactaactaagttatttaacttacgttaccccgttaggtcggtaccgttcgggaccgtaacggggtaaccgtaaagggtacggtaacgtaccgaaccgtaagttcggtaggtccttaggaccctaaccctacgttaccgttcgttaccctttacaccgtttcccgttccccgtacc

SEQ ID NO: 216091 - DNA, 572 bp, Homo sapiens
  misc_feature: GYAE6OF02HBU8C.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgattctttagcctggttgcagcagaaaccagggcgacgcccctcagactcgtagtctatggtgcatccagtattgcaagggtcgggtacccagtccgaggttcaggtggctagtgcatcgtgggacagattacactctcactatcagcagcctgcagcctagaagtatttttagacttaaattttacttacgtagtactaacgtagtttaattaacttacggtaacccctaggttacggtacggtttacccgggccggtaaggggtaaccctaaggggttacggtaaacgttacccggaaaccggtaaccgttggtacggtccgttagaaccccg

SEQ ID NO: 216092 - DNA, 733 bp, Homo sapiens
  misc_feature: GYAE6OF02G1LBD.1.34.D01.1.454.CMB.1.raw
  modified_base (102)..(102): a, c, t, g, unknown or other
  misc_feature (102)..(102): n is a, c, g, or t
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgntcagctcctgggctcctgctgctctggctcccaggtaccagctgtgacatccaattgacccagtctccatcctcctgtctgcagtctattggagacagagtcaccatcacttggccgggngagtcaggccatcagcgtattcttagccttggtncagcaacgaaaccgngggccacgcccctnagactcgtagtctagtggtcgcacgtccagtacttggacgtaaggggttcgggtcccagtccgaggttcgaggttcggacctaggtcgacgtacgttcggtacggggaacctaggtacgtttaacctaccgttacttaccgtaacttactcgtaacggtctaacggtcccttagaccgtacgtacccgttaaggtaaacgtttacgttttacggaacctttaaacgttttaacgtttaccgttacggtaacctaaaaccggttaagttttaaacgtttaaaccgttaaaccggtttaacccccgttaaggggtttaaccgggttaccgggtttacccgggtaaccgggttaaaccgggggtaacccggtaaaggggttaaccgggtaaacgttaacccggtaaacccggttaacggttacggttaccgggttaccgtaccgtaacccg

SEQ ID NO: 216093 - DNA, 720 bp, Homo sapiens
  misc_feature: GYAE6OF02HHFIC.1.34.D01.1.454.CMB.1.raw
  modified_base (206)..(206): a, c, t, g, unknown or other
  misc_feature (206)..(206): n is a, c, g, or t
tcagacgagtgcgtcacgaccggtgctcgatttagatcgtctgtgttggggtttgggggagtcagaccctgtcaggaccacacgcgattggacattgagggttccccgctcagctcctggggctcctgctgctctggctccctaggtaccagctgtgactatccaattgaccctagtctccatcctcctgtctgcatctattgganacgagggagtccaaccatcgaccgttcggccgggtacgagtccaggccagtcagcgtatttcttagccttggttcgcagtcaagaaaccgagggacgacgcccctcgacgacgtcgtagtctagtgggtcgcgatccgaggtacgttggacgtaaggggttcggtaccctacggttccgtaagggttaccgaaggttcggactaggtcgactacgttcggtacggggactacggtaactttaccacttctaccaacttacgacacgacctacgacctacgacctacgtaccgttagtaacgttacgtttacgtaacttaaagtttttactacgtacgttacgtaaacgttagttaaagttacttaacccgtaaccccgtttaacggtacgggttaaccggtttaccgggaacccgggttaaacggggaaacccgttaaacggggttacgtaaaccggttaacccgaaaccgggtaaccgttacggggttacgggtaccttaccgggtaaacccg

SEQ ID NO: 216094 - DNA, 399 bp, Homo sapiens
  misc_feature: GYAE6OF02I726S.1.34.D01.1.454.CMB.1.raw
  modified_base (384)..(384): a, c, t, g, unknown or other
  misc_feature (384)..(384): n is a, c, g, or t
  modified_base (390)..(399): a, c, t, g, unknown or other
  misc_feature (390)..(399): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtgacgttcgccgaggggaccaggtgaagtcaaccgaatgtggctgcaccatctgtcttcacttccttccccaccctcctcacgccactcgtctggacgccgggctgggcaaggcncatagnnnnnnnnnn

SEQ ID NO: 216095 - DNA, 384 bp, Homo sapiens
  misc_feature: GYAE6OF02JEH12.1.34.D01.1.454.CMB.1.raw
  modified_base (373)..(373): a, c, t, g, unknown or other
  misc_feature (373)..(373): n is a, c, g, or t
  modified_base (378)..(384): a, c, t, g, unknown or other
  misc_feature (378)..(384): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccagggaccaggtggaagtcaacgactgtgctgcacatctgtcttcatccttcccgcctatctgaacgcactcgtctgagcggctggcaaggcncatgnnnnnnn

SEQ ID NO: 216096 - DNA, 537 bp, Homo sapiens
  misc_feature: GYAE6OF02GG7CV.1.34.D01.1.454.CMB.1.raw
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgacgcccctcagatcgtagtctatggtncatccagtattgctaagggtcgggtcccagtccaggttcaggtggcagtgcatcgtgggacagacttacactctacactatcagcacgccttgacagtccctagaagtattttgaacttaatttacttacttgtactaactagttattaactacgtaccctagtgtaccggttcggaccggtaacgggaacctaagggtacggtaacgtaccgaacggtactggtacggtctgtaacc

SEQ ID NO: 216097 - DNA, 398 bp, Homo sapiens
  misc_feature: GYAE6OF02GYIC1.1.34.D01.1.454.CMB.1.raw
  modified_base (384)..(384): a, c, t, g, unknown or other
  misc_feature (384)..(384): n is a, c, g, or t
  modified_base (389)..(398): a, c, t, g, unknown or other
  misc_feature (389)..(398): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacaactagtattatacgtacccctacgtggacgttcggccaggggaccaaggtggaagtcaaccgatgtgctgcacatctgtcttcatccttccgcatctgaacgcactctctgacgcgggctggcaaggccganatagnnnnnnnnnn

SEQ ID NO: 216098 - DNA, 536 bp, Homo sapiens
  misc_feature: GYAE6OF02H9GX8.1.34.D01.1.454.CMB.1.raw
  modified_base (279)..(279): a, c, t, g, unknown or other
  misc_feature (279)..(279): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagcctggttgcagcagaaccagggcgagcccctnagatcgtagtctatggtgcatccagattgcgtaagggtcgggtcccagtcccaggttcaggtggcagtcgcagtcgtgggacagattacacttctcactatcagcagcctgcagctagaatntttgacttaatttattactcgtacaacgttagtaacttacacgttacccctaggtacggtaccggtttcggaccggacggggtaccaagggttacggaacgtacgaaccggtacgttggtacggtcgtagacccg

SEQ ID NO: 216099 - DNA, 419 bp, Homo sapiens
  misc_feature: GYAE6OF02JHBK5.1.34.D01.1.454.CMB.1.raw
  modified_base (402)..(419): a, c, t, g, unknown or other
  misc_feature (402)..(419): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagtattttgactaatttattactgtacaacagtaattatagtaccccctagtggacgttcggaccaggggaccaaggtgaacgtcaaaccgaactgtggctgacaccatctagtcttacatccttcccacctcctcacgcctactccgtctgacgcggcgtggacaacggcacatagnnnnnnnnnnnnnnnnnn

SEQ ID NO: 216100 - DNA, 491 bp, Homo sapiens
  misc_feature: GYAE6OF02I58CK.1.34.D01.1.454.CMB.1.raw
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtggggtcccatccaggttcagtggcagtgcatctgggacagattacactctcactatcagtcagcctgcagcctgaagattttgctaatttattactgtcaactntattatagtaccctagtcggtacgttcggccgaggggaccaaggtaggaagtcgaccgagtggtggctagcacatctgtcttcacttcctcccgtcc

SEQ ID NO: 216101 - DNA, 615 bp, Homo sapiens
  misc_feature: GYAE6OF02J2RXB.1.34.D01.1.454.CMB.1.raw
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgattcttagcctggtncagcagaacaggcagccctnagatcgtagtctatggtgcatccagtnttgcgtaaggcgggtcccagtccgaaggttcaggtggcagtcgctagtcgtagggacagtacttacacgttctaccgactacgtacaacgtcgaacgtccgtaggcctacgtaccgttaggtaaacgttattttacggtacttaaacttttagtttaccttacgtaactaacgttaacgttaacttttaacgtacccgttaacccgttacggttcggtaaccggtttcgggaacccggttacgggaaaccggttaacgggtaacgggtaacgtaaccggtaaccggtaagtacggtcggtaccgtccgtaacccg

SEQ ID NO: 216102 - DNA, 595 bp, Homo sapiens
  misc_feature: GYAE6OF02GB0OU.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagatcaccatcacttgccgggnagtcaggccatcagcgattcttagcctggttgcagcagaaccagggcgacgcccctnagatcgtagtctatggtncatccagatttgacgtaagggttcgggtacccagtcccgtagggttccaaggttcgggactaggtggacctaagtcggtacggggaactaaggtaattaccaacttctactaacttatccagcaacgcctagcacgtccctagtaagtactttttgaactttaaatttaacttacttagtactaacgtagttaactttaacgtaacgttaccccgttaggttcggtacggttcccggacggtaacgggaaccgtaaggtacggaagtaccgaacccggtagtacggtcggtactgaacc

SEQ ID NO: 216103 - DNA, 585 bp, Homo sapiens
  misc_feature: GYAE6OF02IA3Y6.1.34.D01.1.454.CMB.1.raw
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagccttggttgcagcagaaaccgagggccgagcccctnagatcgtagtctagtggtncatccagtattggacgaagggtcgggtcccagttccgaggttcaggtggctagtgacagtcgtgggactagtacttaccacttcctactacttancgagacacgtcctcgacacgcctagtaagttacttttaggacttaaattttacttacgttacgtaactaacttaagttaattacgttaaccgttacccctaggtacggtaaccgttcgggaaccgtaccggggacctaagggtacggtaacgtaccgaaaccggtacgtaggtacggtactagaccc

SEQ ID NO: 216104 - DNA, 558 bp, Homo sapiens
  misc_feature: GYAE6OF02GLH49.1.34.D01.1.454.CMB.1.raw
  modified_base (257)..(257): a, c, t, g, unknown or other
  misc_feature (257)..(257): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttncagcagaaaccagggcgacgcccctacagactcgtagtctagtggtgcatccagattgacgaagggtcgggtcccagtccgtaggttcaggtggcagtgctatcgtgggaacaggtattaacaccttctactaactatacagcacgcctgcacgtcctagtaagtatttgaacttaatttacttactagtacaactagttaacttagtaaccgttacccgtacggtcggtaccgttaccgggacgacgggaaccgtaaggtacggtaacgtacgaaccggtacgtggtacggcctagaccc

SEQ ID NO: 216105 - DNA, 532 bp, Homo sapiens
  misc_feature: GYAE6OF02I3DF9.1.34.D01.1.454.CMB.1.raw
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaaccaggggcgagcccctcagactcgtagtctatggtncactccagattgcaagggtcgggtcccatccgagttcaggtggcagtgcatcgtgggacagtattacactctacactatcagcagcctgcagcctgaagtatttgactaatttacttatgttacaactagttaattacgtaacgtaccctacggttcggacgtttccggccgtaaggggtacctaagggtaggaacggtaccaaccggtaactcggtacggacgtgaaccc

SEQ ID NO: 216106 - DNA, 617 bp, Homo sapiens
  misc_feature: GYAE6OF02JA37Z.1.34.D01.1.454.CMB.1.raw
  modified_base (309)..(309): a, c, t, g, unknown or other
  misc_feature (309)..(309): n is a, c, g, or t
  modified_base (419)..(419): a, c, t, g, unknown or other
  misc_feature (419)..(419): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccagtcagcgattcttacgcctggttcgcagacacgaaaccgagggcgacgcccctcgagactcgtagtcctagtggtcncactaccagtattgacgtaagggtcgggtacccagttccgaggttcaggtcgacgacgtgacctatcggtacgggactaaggtactttaccactcgttaccaacttaacnccgtacgactacccgtctcgggacaacgtccgttagggaaactttgtttcgaacttaattttacgtactggtaactaacgttgttaacttacgtaaccgtacccttaggtcgttaaccgttaccgggacgggtaaacggtacgtaacgggtaacgttaacgtaacgaccgtaacggttgtaccggtgtaccgtaaccg

SEQ ID NO: 216107 - DNA, 588 bp, Homo sapiens
  misc_feature: GYAE6OF02JD667.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattcttagcctggttgcagcaacgaaaccgaggcgacgcccctacagatcgtagtctatggtgcatccagtattgacgtaagggtcggggtcccagtccgtaaggttccaggtcgggactaggtcgcgtagtcgtagggacagtaacttacactctacactactacgacgacacggcctagacgagacctagaacgttatttcgaacttaatttattaactgtaacaacgtattacgtactaccgttacccgtacgttggtaccgttcggaccggagggtaacgtaggtacgaacgtacgacgtaacgtggtcggtacacgacctacgtacgtacgttcgttaccttacgtacttacccgtccccgtaccccg

SEQ ID NO: 216108 - DNA, 546 bp, Homo sapiens
  misc_feature: GYAE6OF02JSBQ3.1.34.D01.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttgccgggcagtcaggccatcagcgattcttagcctggttncagcagaaaccagggcgacgcccctcagatcgtagtctagtgggtncatccagtattgcgtaaggtcgggtccatcgaggttcaggtgcagtgacatcgtagggacagtattacactctacatactcacgcacgcctgcacgtctagtaaacgttgtttcgaacttaagttttacttacgtacgttacaagttacgttattaacgtacgttacccgtaggtcggtacgttaccggcgtaacgggactaacgggtagaacgttaccgaacggtacgtggtacggtcagtaaccg

SEQ ID NO: 216109 - DNA, 538 bp, Homo sapiens
  misc_feature: GYAE6OF02IT1GN.1.34.D01.1.454.CMB.1.raw
tcagacgagtgcgtcacgaccggtgctcgatttagatcgtctgtgttgggtttgggcatggacatgagggtccccgctcagctcctgggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaagggtcgggtcccatccgtaggttcagtggacagtgcatcgtgggacagacttacactctacactatcagcagcctgcagcctagaagtatttgactaatttacttacttagtacaactagtattactaactaccccgtagtcggtacgttcggaccgacgggaaccgtaagggtaggaacgtaccgaaccgacgtacggtcggtactcgacacctagtcctagttacttcctacttccgtacccgtacc

SEQ ID NO: 216110 - DNA, 598 bp, Homo sapiens
  misc_feature: GYAE6OF02G4K25.1.34.D01.1.454.CMB.1.raw
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttncagcagaaaccagggcgagcccctnagatcgtagtctatggtncatccagattgacgaggtcgggtccatccaggttcaggtggcagtgcatcgngggacagattacactctacactatcagcacgcctgaccacgccgtagaacgttatttttaggacttaaacgttttattaaccgttgttaaccaaaccgttaggtttaaactttaagttaaccggttacccccttaacgggttcgggtaaccggttttccgggaacccggtaagggggaacccgtaaggggttaccggtaacggttacccaaacccggtaacggttgggtacgggtaccttaggaacccg

SEQ ID NO: 216111 - DNA, 682 bp, Homo sapiens
  misc_feature: GYAE6OF02HZCXY.1.34.D01.1.454.CMB.1.raw
tcagacgagtgcgtcacgaccggtgctcgatttagatcgtctgtgttgggtttgggggtaggtcgagaccctgtcaggacacagcatggacatgagggtccccgctcagctcctggggctcctgctgctctggctcccaggtaccagctgtgacatccaattgacccagtcctccatcccctcccgtgtcctgacaacttccgtaatttgggagaaccagacgtcaaccatccacttcggcccggggcaagtccaagggccaatcagccgaattcgttagccttggttgcctagcaagaaacccgaggggacgacgccccctagacgacgtacgtaacgttctaacgtgggtcgacaactccgagtattcggacgtaaagggtcggggtccccaagttccgaacggttcaaggtggacctaggtgtcagttcgagggaacgtagaacttacacgttctacgacttatcagtaccagtccctgaccacgcctaggtaaatacttttaggacttaaaactttttaataccgttgttaacaaaccgttaagttaacgttaaattaaccgttaacccctaggtacggttaccggttaccggaccggtaacgggaaccgtaaaggggtaggtaaacgttacccggaaaaccgaacgggtttaccggtggtacccgtacgggtaaccc

SEQ ID NO: 216112 - DNA, 396 bp, Homo sapiens
  misc_feature: GYAE6OF02JASZZ.1.34.D01.1.454.CMB.1.raw
  modified_base (381)..(381): a, c, t, g, unknown or other
  misc_feature (381)..(381): n is a, c, g, or t
  modified_base (387)..(396): a, c, t, g, unknown or other
  misc_feature (387)..(396): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatagtaccccctagtggacgttcggccaggggaccaaggtggaagtcaaccgaactgtggctgcaccatctgtcttcatccttcccaccctctcacgccaccgtctgacgcggctggcaaggcncatagnnnnnnnnnn

SEQ ID NO: 216113 - DNA, 528 bp, Homo sapiens
  misc_feature: GYAE6OF02I2EF3.1.34.D01.1.454.CMB.1.raw
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (352)..(352): a, c, t, g, unknown or other
  misc_feature (352)..(352): n is a, c, g, or t
  modified_base (516)..(516): a, c, t, g, unknown or other
  misc_feature (516)..(516): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagccaccatcacttgccgggcgagtcaggccatcagcgattctttagcctggttgcagcagaaaccngggcagcccctnagatcgtagtctaatggtgcatccagattgcaaggtcgggtcccagtccaggttcaggtggcagtgcatcgngggacagtatacactctcactatcagcacgcctgacagtcctagaacgtattttcgacttaatttattactgtactaagtagttaattacttaacgtaccctaggtcggtacgttaccggcgaacgggaccgtaaggtacgtaacgtacgaaccggaacgtggnggtacgtgtacc

SEQ ID NO: 216114 - DNA, 513 bp, Homo sapiens
  misc_feature: GYAE6OF02HA68G.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctcagatcgtagtctatggtgcatccagattgcaaggtgggtcccatccaggttcaggtggcagtgcatcgtgggacagattacactctcactatcagcagcctgcacgcctagaagtattttgacttaattttattactgtacaactagttaattactaacgttaccctagtcggtacgttcggaccgaggggaacctagggtacgaagtacgaaccgacgttggcggtctgacc

SEQ ID NO: 216115 - DNA, 566 bp, Homo sapiens
  misc_feature: GYAE6OF02GFTFC.1.34.D01.1.454.CMB.1.raw
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtncatccagattgctaagggtcgggtcccagtccgaggttcaggtggcagtgcagtcgtgggacagtacttacactctacactatcagcacgcctgcacgtcctaggaacgttnttttgacttaaattttatactagtacaactagtttaattaacgtacgttaaccccgtaggttacggtaccggttaccgggaccgtaacggggaacctaaggggtacgtaaacggtaccaaaccgggtaacgttgggtacggtctacggtaaccg

SEQ ID NO: 216116 - DNA, 573 bp, Homo sapiens
  misc_feature: GYAE6OF02HCHBY.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcagaaaccgagggcgacgcccctcagatcgtagtctatggtgcatccagtattggacgaagggtcgggtaccccagttccgaggtttcaggtggacagtgctatcgtagggacagtattaccactctacactatcgagcacgcctgccagcctagaatattttagacttaatttacttacgtagtacctaaactagttaattacgtaaccgttaccccgttacggtacggtaccggtttaccggaccggaacggggtaacctaagggttacggaacgtaccgaacccgtaagttcgggtacggtctaggtaccc

SEQ ID NO: 216117 - DNA, 509 bp, Homo sapiens
  misc_feature: GYAE6OF02FQAB1.1.34.D01.1.454.CMB.1.raw
  modified_base (282)..(282): a, c, t, g, unknown or other
  misc_feature (282)..(282): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagtattgcgaaggtcgggtcccagtccaggttcaggtggcagtgcagtcgtgggacagtacttacactctcactatcagcagcctgcagcctagaagtntttagactaatttatactgtactaatagtaattactacgtaccctagtcgtacgttcggccgagggacctaagggtacgaagtacgaaccgagtgtcggctgacc

SEQ ID NO: 216118 - DNA, 509 bp, Homo sapiens
  misc_feature: GYAE6OF02JLXIW.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgaagcccctcagatcgtagtctatggtgcatccagtattgcaaggtgggtcccatcagttcagtggcagtgcatcgtgggacagacttacactctacactatcagcacgcctgcacgctagaagtatttgactaatttatactgtacaatagtattatacgttaccctagtacgtagtaccggcgtagggaccgtaaggtacggtaagtaccaacggtactaggtcggtctagtaccg

SEQ ID NO: 216119 - DNA, 611 bp, Homo sapiens
  misc_feature: GYAE6OF02JY325.1.34.D01.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttgggtttgggggtagtcgagaccctgtcaggacacagcatggacatgagggtccccgctcagctcctgggctcctgctgctctggctcccaggtaccagctgtgacatccaattgacccagtcctccatcctccctgtctgcatctattgganacagatcaccatcacttgccggngatcaggccatccagcgattcttagcctggttncagtcaggaaaccagggtcgaagccccctagacgtactcgtagtctaatggtgcacgtccagtattgcgaaggtcgggtcccagtccgtaggttcaagtcggctagtgactatcgtgggtaccagtactactaaccgtncgtactatcacggtnacgcctgacacgtccgtagtaaacgtagttttccggtaacttaacgttttaactaccgtttacggttacctaaaccgttagtttaaccttaaagttaaccgttaacccccgtttagtacggtacgttttccggaaccggtaggaccgttaaacggtaggtacgtaacgtaaccggacgttaggtcggtaccgtagtaacccg

SEQ ID NO: 216120 - DNA, 410 bp, Homo sapiens
  misc_feature: GYAE6OF02GEOA2.1.34.D01.1.454.CMB.1.raw
  modified_base (352)..(352): a, c, t, g, unknown or other
  misc_feature (352)..(352): n is a, c, g, or t
  modified_base (384)..(384): a, c, t, g, unknown or other
  misc_feature (384)..(384): n is a, c, g, or t
  modified_base (391)..(410): a, c, t, g, unknown or other
  misc_feature (391)..(410): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagtattttgctaattttattactgtcaactagtattatacgtacccctagtggaccgttcggccaggggaccaaggtgaagtcaaccgatgtgctgcacatctgtcttcatcctcccgccctctcacncactcgtctgacgcggactggacgaagtccgnagtacgnnnnnnnnnnnnnnnnnnnn

SEQ ID NO: 216121 - DNA, 665 bp, Homo sapiens
  misc_feature: GYAE6OF02JI7DL.1.34.D01.1.454.CMB.1.raw
  modified_base (228)..(228): a, c, t, g, unknown or other
  misc_feature (228)..(228): n is a, c, g, or t
tcagacgagtgcgtcacgaccggtgctcgatttagatcgtctgtgttgggtttgggggagtcagaccctgtcaggacacagcatggacatgagggtccccgctcagctcttggggctcctgctgctctggctcccaggtaccagctgtgacatccaattgacccagtctccatcctccctgtctgcattctattggagacagagtccaacctatctacttgccggggnagtcaggccatcagcgtattctttagcctggttcgcagcaagaaccgagggcgacgcccctcagactcgtagtctagtggtcgacatccagtacttggactaagggtcgggtacccagtccgaggttcaggtcggctaggtcgcgtaacgtcgtacgggaactaggtaactttacgacttcgtaccaacttactacaacgctaacggcccttaggaccacgtacccgtagtaaacgtttagttttcgaagttaaactttttagttaccttacggttaacctaaacgttaacgttttaaacgttacgttaaccgttaaccccgttacgggttacgggttaaccggtttacccggaacccggggtaaagggacccggtaaaagggtacggtaacgtaaccgtaaccggtaccgttagggtacggtccttacggaacccg

SEQ ID NO: 216122 - DNA, 687 bp, Homo sapiens
  misc_feature: GYAE6OF02GVSG0.1.34.D01.1.454.CMB.1.raw
tcagacgagtgcgtcacgaccggtgctcgatttagatcgtctgtgtggggttggggagtccgagaccctgttcaggacacagctagttggggacgactggagggtccccgctacagcgtcctgggctcctgcgtcgcgtctccggccttaccctacggttaccccacgtcctcgttcgacctatcccaaattcgaacccctagttcctccgacttccctccctgtctgcactctagttcggacgacgagtacgtcacctactccgacgttcggccggggacgacgtcgaacggcccaacgtcgacgtcgtagtttacgtttacgccgttggttcgacgaacgacgaacgaaaccgtacgggtaccgtaccgtaccccgtagaacgtacgtacggtagtacgtacgtcggtcgaccgtacctcgtagttagtacgacgtaagggttacggtacctacgttcgaggttacgacgtcggacgtacgtgctacgtcgtcggactacgtactacgctcacactacgacacgcgtacgtcctagacctacgtcgtaggtaacgttcgtttacgacttaagtttacgtacgtagtactaagttatttaactacgtaccgtaccgtaggtcgtacgtccgacggtaacggacgtagggtacgtactaccgtacgtagtcggtacgtcgacgtacg

SEQ ID NO: 216123 - DNA, 537 bp, Homo sapiens
  misc_feature: GYAE6OF02GUZ0Q.1.34.D01.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (360)..(360): a, c, t, g, unknown or other
  misc_feature (360)..(360): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcagaaaccagggcgacgcccctnagatcgtagtctagtggtgcatccagtattgacgaagggtcgggtcccagtccgaggttcaggtggcagtgcagtcgngggacagtattacactctcactatcagcagcctgccagtcctagaagttattttacggactttaaatttacttacttacgtactaacgtagttaattacgtaacgttacccctagttcggacggttcggaccgaaggggtaccaagggtaggaagtaccaacggatgtacggctgcc

SEQ ID NO: 216124 - DNA, 634 bp, Homo sapiens
  misc_feature: GYAE6OF02JL64J.1.34.D01.1.454.CMB.1.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (386)..(386): a, c, t, g, unknown or other
  misc_feature (386)..(386): n is a, c, g, or t
tcagacgagtgcgtcacgaccggtgctcgatttagatcgtctgtgttgggtttgggggtaggtcagaccctgtcaggacacagcatggacatgagggtccccgctcagctcctgggctcctgctgctctggctcccaggtaccagctgtgacatccaattgacccagtctccatccctccctgtctgcatctattgganacagatcaccatccacttcgccgggcagtcacggccatcagcgattcttagccttggttgcagcagaaaccgggacgacgccccgtnagtactcgtacgtctagtaggtgacacttccgaagtattggcgtaaaggggtcgggttaccccagtccgtaggttacaggtcggcaagtcgacagttcgngggaacagtaacttacacttctactactatctacgctagccctgaccgaacgtccctaggaacgtttatttacgtacgttaaatttttcgttaactcgttacctaacgtaagtttaactttaactaacccggttaaccccttaaggtccggttaacggttcccggtaaccggtaaggggtaacccggtaaggtttaccggggaaacttacccgggaaaccgtacgttacgggttcggtctaggtaccc

SEQ ID NO: 216125 - DNA, 681 bp, Homo sapiens
  misc_feature: GYAE6OF02JM8TZ.1.34.D01.1.454.CMB.1.raw
  modified_base (219)..(219): a, c, t, g, unknown or other
  misc_feature (219)..(219): n is a, c, g, or t
  modified_base (513)..(513): a, c, t, g, unknown or other
  misc_feature (513)..(513): n is a, c, g, or t
tcagacgagtgcgtcacgaccggtgctcgatttagatcgtctgtgttgggtttgggggagtcagacccgtgtcaggacacagcgatggaccactgagggtccccgcgtcagctcctcgggcctcctcgcctgctctggctcccagggtacccaggcctgtgacactccaattcgacccagtcctccagtcccgtccctgtctacgccatctattcgganacctagagtcaacctagtccacttggcccgggacgtaggtccgaggccaattcagcgttatttcttacgccgtcggttacgaccacgtcgaacgaaaacccgcgggaccacgcccctcgtagtacgtacgtagtcctaagtcggtcgacgacgtccgagtacttcgcgtaacggtccggtcctacgtccgtaaggttcaggtcggactacggtcgcctagtccggtcgggactacggtacttacgcgtctacgactatcgagacgtagaccttgacacgtcctaagtaacgttntttagaccttaatttacgtacgtacgtaacgttacgttaacgtttagtaaccgttaaccggtaccccgttaaggtacgttaccggggttaccgaccggttaacgggaccgtaacggtacggaccgttacccgaaccggtaccgttaggtacgtccgtaccggtacccc

SEQ ID NO: 216126 - DNA, 506 bp, Homo sapiens
  misc_feature: GYAE6OF02F4TSY.1.34.D01.1.454.CMB.1.raw
  modified_base (375)..(375): a, c, t, g, unknown or other
  misc_feature (375)..(375): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctagtggtgcatccagtattgcgaagggtcgggtcccagtccgaggttcagtggcagtgcatcgtgggaacagtattacacttcnctactatcagcagcctgccagcctagaagtattttgacttaatttattactagtactaacgtattaattactacgtaccctagtcgtacgtcggcgagggaccaggtagacgtcgaccgtagtgngcngac

SEQ ID NO: 216127 - DNA, 469 bp, Homo sapiens
  misc_feature: GYAE6OF02G33U1.1.34.D01.1.454.CMB.1.raw
  modified_base (252)..(252): a, c, t, g, unknown or other
  misc_feature (252)..(252): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
  modified_base (433)..(438): a, c, t, g, unknown or other
  misc_feature (433)..(438): n is a, c, g, or t
  modified_base (440)..(469): a, c, t, g, unknown or other
  misc_feature (440)..(469): n is a, c, g, or t
tcagacgagtgcgtcacgaccggtgctcgatttagatcgtctgtgttgggtttgggtagtcaggccatcagcgattctttagcctggttgcagcagaaaccagggcgagccctcagatcgtagtctatggtgcatccagattgcaaggtggggtcccatccaggttcagtggcagtgcatctgggacagattacactctcactatcagcagcctgcagcctgaagtattttgctaattttattactgtcaanagttattatagtaacccctagtggacgttcggccaggggaccaaggtgaagtcaaaccgaagtgtgtctgcaaccatctagttcttactatccgttcccgcctattctacgaacgtccacttccgtcttacgaggccgggtactggggaacaagggggtccngtaacgttaggcngacgcnnnnnncnnnnnnnnnnnnnnnnnnnnnnnnnnnnnn

SEQ ID NO: 216128 - DNA, 566 bp, Homo sapiens
  misc_feature: GYAE6OF02HF8UP.1.34.D01.1.454.CMB.1.raw
  modified_base (400)..(400): a, c, t, g, unknown or other
  misc_feature (400)..(400): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccgagggcgacgccccctagagatcggtagtctagtggtgcatccagtattgactaagggtcgggtacccagttcccgaggttccaggttcggcaggtcgactatccgtgggacagtacttacgactctcaactntcgagcacgcctgaccagcctaggaacgttntttacgacttaaattttacttactagtacaactagtttaatacttaaccgtaccctaggttacgtacgttcggaccgtaacgggacctaaggtggaaacgtaccgaaccggtagtcggtacggtcgtacgacccg

SEQ ID NO: 216129 - DNA, 692 bp, Homo sapiens
  misc_feature: GYAE6OF02HW5J2.1.34.D01.1.454.CMB.1.raw
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (384)..(384): a, c, t, g, unknown or other
  misc_feature (384)..(384): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcattggccgggcgagtcaggccatcagcgtattctttagcctggttncagcagaaccagggacgacgcccctanagtatcgtagtctatcggtanctatccgagattgacgtagggtcgggtaccagtccgaggttcaggtggacagtcgctagtcgtagggacagtacgttacnccgttctaaccagtactacgacgcaacgtcctaggaccgtaggtacctaggtaaagttagtttttacgacttttaaaacgttttactttaacccggagtttaaacccgaaactttaagttttaaaccgttaaacgtttaacccggttaaaccccgtttaccggttaggggttaaacccggtttcccggggtaaacccggtaaaccggggggtaaccgttaaagggggttaaccgggtaaaccggttacccccggtaaaaccgggtaacccgttttacggggaccggtttacccgtacggtaaaccccg

SEQ ID NO: 216130 - DNA, 538 bp, Homo sapiens
  misc_feature: GYAE6OF02GE18K.1.34.D01.1.454.CMB.1.raw
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccaggggcagcccctcagatcgtagtctatggtgcatccagattgcgaaggtcggggtcccagtccgaggttcagtggcagtgcatcgngggacagtattacactctcactatcancagcctgacgacgccgtagaagtattttagacttaagtttacttactagtacaacgtagttaattactaacgttaccctaggtggtacgttcggccgaacggggaactaacgggttaggaacgtacgaaccggtaacgttcggtacggtccgtgaccg

SEQ ID NO: 216131 - DNA, 513 bp, Homo sapiens
  misc_feature: GYAE6OF02HA7DA.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaagggtcgggtcccagtccgaggttcagtggcagtgcatcgtgggacagattacactctcactatcagcagcctgcagcctagaagtattttgactaatttacttactgtcaatagttattactacgtaccctacgtcgtacgttcggaccgagggtaccaaggtcggaagtaccgaaccgaacgtggacggtcgtgaccg

SEQ ID NO: 216132 - DNA, 392 bp, Homo sapiens
  misc_feature: GYAE6OF02I35C2.1.34.D01.1.454.CMB.1.raw
  modified_base (380)..(380): a, c, t, g, unknown or other
  misc_feature (380)..(380): n is a, c, g, or t
  modified_base (386)..(392): a, c, t, g, unknown or other
  misc_feature (386)..(392): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttcccgccatctgaacgcaactcgtctgagcgggctggcaaggcncatagnnnnnnn

SEQ ID NO: 216133 - DNA, 595 bp, Homo sapiens
  misc_feature: GYAE6OF02GYFCM.1.34.D01.1.454.CMB.1.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagccttggttncagcaagaaaccgngggcgacgcccctanagatcgtagtctagtggtncactccagtattgacgaagggtcgggtacccagtccgtaggttcaggtcggcgtagtgactagtcgtgggaacagtacttacactctacatatcagcacgcctgactagcctagaacgttnttttagactttaatttacttacgttagtactaaactagtttaacttaacgttaaccgttaccccttagggttacggtaccggttccgggaaccggtaacggggtaaccgtaagggttacggtaaacggttaccgaaaccggttacgttacggtacggtctacgtacccg

SEQ ID NO: 216134 - DNA, 504 bp, Homo sapiens
  misc_feature: GYAE6OF02HXDP9.1.34.D01.1.454.CMB.1.raw
  modified_base (380)..(380): a, c, t, g, unknown or other
  misc_feature (380)..(380): n is a, c, g, or t
  modified_base (469)..(469): a, c, t, g, unknown or other
  misc_feature (469)..(469): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctcagatcgtagttctatggtgcatccagattgcaagggtcggggtcccatccgaggttcgaggtggcagtgcatcgtgggacagtacttacactctcactatcagcagccctgcagctagaagtntttgacttaatttattactgtacaatagtattatacgtaccctaggtcgtacgttcggacgagggacctaggagagtacaccgtatggngtctggccacagtctcgttctcgtactcctccgac

SEQ ID NO: 216135 - DNA, 539 bp, Homo sapiens
  misc_feature: GYAE6OF02H6ZPZ.1.34.D01.1.454.CMB.1.raw
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (523)..(523): a, c, t, g, unknown or other
  misc_feature (523)..(523): n is a, c, g, or t
tcagacgagtgcgtcacgaccggtgctcgatttagatcgtctgtgttgggtttgggcatggacatgagggtccccgctcagctcctgggggctcctgctgctctggctcccaggtaccagctgtgacatccaattgacccagtctccatcctccctgtctgcatctattggagacagagtcaccatcacttggccgggcgagtcaggccatcagcgattcttagcctggttgcagcagaaccagggcgacgcccctnagatcgtagtctatggtgcanccagattggactaaggggttcgggcccagtccgaggttcaggtggcaggtgctatcgtgggacagattacacttcctactactatcgagcacgcctgccagccttagtaagtatttagacttaatttacttacttgtactaagtattattactaccgtaccctaggttcgacggttcggacgtacgggacgaggtagaacgtaccgacgtactggtcgcgtcgacctctacttcgtcttcttacncttccctcccctaccc

SEQ ID NO: 216136 - DNA, 696 bp, Homo sapiens
  misc_feature: GYAE6OF02H26AK.1.34.D01.1.454.CMB.1.raw
tcagacgagtgcgtcacgaccggtgctcgatttagatcgtctgtgttgggtttgggggagtcagtaccctgtcaggacacagcatggacatgagggtccccgctcaggctcctggggctcctgctgctctggctcccaggtaccagctgtgacatccaattgacccagtctccatcctcctgtctgctagtctattggagacagagtcaccactactacgtcggccggatacgacgccgatactagacgtattactttacgttacgtacgttggtcacgacgacgaaaccgaacgggcggacgaccctccctagagtcggtagtaccttataggtcggtacacttaccgagtaagtcgtacgaacggtacggggttcccgactacgtacggtagtcgtagggtcggactggtacagttacgttcggacggtaagtaacgttacgtacctacgttcctaacgtactactacgtacgctaccggtccgtagtaacggaccgttagtaaacgggttatttggaaccttaaacgttttaactttaccgttagttcctaaaccgtattaacgttaactttaccgtaacccccggttaacggtcggttaccgttccgggtacccggtaaccgggtaaccgacgggtaacggttaaccgtaccgaacccgttacggaccggttggacccgtgtacctaacccg

SEQ ID NO: 216137 - DNA, 609 bp, Homo sapiens
  misc_feature: GYAE6OF02HJXII.1.34.D01.1.454.CMB.1.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (419)..(419): a, c, t, g, unknown or other
  misc_feature (419)..(419): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccggcgagtcaggccatcagcgattctttagcctggttgcagcagaaaccagggcgacgcccctnagatcgtagtctagtggtncatccagtattgcaagggtcgggtcccatccgaggttcaggtggacagtgcagtcgtagggacaagtacttacaccttctacaacttatacgagtcagcctgcagtcctagtaagttnttttagacttaaagttttacttacgtagttaacctaacttagttaactttagtaacccgttaaccccgtacggtaccgggtaaccgtttccgggaacccggtaacgggggtaaacccgtaaggggttaaccgggtaaacggttacccggaaaccggtaaccggttggtacgggaccgttacggtaacccg

SEQ ID NO: 216138 - DNA, 576 bp, Homo sapiens
  misc_feature: GYAE6OF02IZQ97.1.34.D01.1.454.CMB.1.raw
  modified_base (283)..(283): a, c, t, g, unknown or other
  misc_feature (283)..(283): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttcgcagcagaaaccagggcgacgcccctnagatcgtagtctatggtgcatccagattgcgaagggtcgggtcccagtccgaggttcagtggcaggtgcatcgtgggacagtattacactctacactatcagcacgccctggccgacgccgtagaacgttnttttacggacttaaattttagttactgtaacctaacgtagtttaattaacgttaaccgtaccccgttaggtaggtccgtttacgggcccggtaaggggtacccgaaagggttaccgggaaagtaccgtaaccggtaaacgtgggtacggcgttacggacccg

SEQ ID NO: 216139 - DNA, 711 bp, Homo sapiens
  misc_feature: GYAE6OF02GKJRT.1.34.D01.1.454.CMB.1.raw
  modified_base (196)..(196): a, c, t, g, unknown or other
  misc_feature (196)..(196): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatgganacagagtcaccatcacttgccgggcagtcaggccatcagcgattctttagcctggttgcagcagaaaccagggcgagcccctgagtatcgtagtctagtggtgcattccaagtattggacgtaaacggggtcgggtaccccaagttcccgaagggtttccaagggttcgggccgtaaggttcggacccgtaattccggttacggggaaccgtaaggtaaactttaacccgaaccgttccttaaaccgtaaccttaacgttaccgaacggtaccgaaacggtccccgttaggacccacggtacccgttaaggtaaacgtttaagtttttaccggacttaaaatttttactttaacgtacgttaactaaacgttagttaactttaacgttaaacgttaccccgtaacggttccgggtaaccgttttacggggacccgtaaacggggtacccgtaaaggggttacggaaacggttaccgaaaccggttaagttacgggtacggttcgtacgtaacccg

SEQ ID NO: 216140 - DNA, 527 bp, Homo sapiens
  misc_feature: GYAE6OF02FSND6.1.34.D01.1.454.CMB.1.raw
  modified_base (299)..(299): a, c, t, g, unknown or other
  misc_feature (299)..(299): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtncatccagattgcaaggtcgggtcccatccaggttcagtggcagtgcatcgtgggacagattacactctacactatcagcagcctgcagcctagaatnttttgacttaatttattactgtacctaatagttaattactaacgtacccctaggtacggtacgttcgggaccgaggggtaccaagggttcggaacgtacgaacccggtaacttcggtaggccgtgtacccg

SEQ ID NO: 216141 - DNA, 175 bp, Homo sapiens
  misc_feature: GYAE6OF02HZBD7.1.34.D01.1.454.CMB.1.raw
  modified_base (167)..(175): a, c, t, g, unknown or other
  misc_feature (167)..(175): n is a, c, g, or t
tcagacgagtgcgtcacgaccggtgctcgatttagatcgtctgtgttgggtttggacgttcggccaggggaccaaggtggaagtcaaccgaactgtggctgcaccatctgtcttcatcttcccgcctcctcacgcactcgtctgagcgggctggcaaggcgcatagnnnnnnnnn

SEQ ID NO: 216142 - DNA, 570 bp, Homo sapiens
  misc_feature: GYAE6OF02IKTWL.1.34.D01.1.454.CMB.1.raw
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtncatccagnttgcaagggtgggtcccatccaggttcagtggcagtgcatcgtgggacagtattacactctcactatcagcacgcctgcacgcctagaagtattttgacttaattttattactgtacctaactagttaattaataaccgttacccgttacggtacgggtaccggtttccgggacccggtaacgggggaacccgtaaaggggtacgggtaaacggttacccgaaacccgggtaaccgttacgggtacgggtacctggtaacccg

SEQ ID NO: 216143 - DNA, 571 bp, Homo sapiens
  misc_feature: GYAE6OF02F6MCS.1.34.D01.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcgacgcccctnagatcgtagtctagtggtgcatccagtattgcgaagggtcgggtcccagtccaggttcaggtggcagtgcagtcgtggggacaggtacttacacttctactactatcgagcagcctgccagcctagtacgtattttcgacttaatttacgttactcgtacaacttagttaattacttaccgtaccctacggttacggtaccgttccgggaccgaacggggtaaccctaaggggtacggtaaacggttaccgaaaccgggtaacgttaggtcgggtaccgtaggacccg

SEQ ID NO: 216144 - DNA, 483 bp, Homo sapiens
  misc_feature: GYAE6OF02I78WP.1.34.D01.1.454.CMB.1.raw
  modified_base (397)..(397): a, c, t, g, unknown or other
  misc_feature (397)..(397): n is a, c, g, or t
  modified_base (477)..(477): a, c, t, g, unknown or other
  misc_feature (477)..(477): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtcgggtcccatccaggttcaggtggcagtgcatcgtgggacagattacactctacactatcagcagcctgcagcctgaagtntttgactaatttattactgtacaatagttatatacgtaccctagtgacgttcgcgagggacaaggtgaagtcaacgatgngctgac

SEQ ID NO: 216145 - DNA, 518 bp, Homo sapiens
  misc_feature: GYAE6OF02GUHED.1.34.D01.1.454.CMB.1.raw
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (476)..(476): a, c, t, g, unknown or other
  misc_feature (476)..(476): n is a, c, g, or t
tcagacgagtgcgtcacgaccggtgctcgatttagatcgtctgtgttggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacgactcgtcactagtcagcagcctagccagcctgaagtattttgactaattttacttactgtacaactagtaattatacgtacccctagtggacgttcggaccgacggggaccaaggtggaacgtcgaaccgaatgtggctgcaccatctgtcttcacgtctccgctatctgaacncactcgtctgngcggtctagggacaacggcgacaagtaggntcanagtcgngtacgnacgnaacgcgtcngcgacgacgtcgtntagtgtgngagacgacgcgcgcgngtacgtagtagtacgtagtagtgtagtagtcgtacgcgtacg

SEQ ID NO: 216146 - DNA, 648 bp, Homo sapiens
  misc_feature: GYAE6OF02I2L7Q.1.34.D01.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (393)..(393): a, c, t, g, unknown or other
  misc_feature (393)..(393): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattcttagcctggttncagcagaaaccngggcgacgcccctnagatcgtagtctatggtgcactccagattcggcaaggggtcgggtcccagtccgaaggtttcagtggcagtcgcagtcgtgggactagacttaacaccttctacacttacncgaagctaacgtcctagccgaacgtccctaggtaaacgttacgtttttcgaacctttaaatttttacttaacccgttagttaaccgtaaacgttagttttaaactttaaacgttaacccggttaaccccgtttacggttcgggttaaccggtttcccgggaacccggtaacgggggaacccgttaaagggttacgggtaaacgttacccggtaaaccggttaaccggttagggtcgggtacccgtggtaaccccg

SEQ ID NO: 216147 - DNA, 536 bp, Homo sapiens
  misc_feature: GYAE6OF02HGVD2.1.34.D01.1.454.CMB.1.raw
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctagtggtgcatccagattgcaaggtcggtcccatccgaggttcagtggcagtgcatcgtgggacagacttacgactctacactatcagcagcctgcagcctagaagtntttgacttaattttacttacgtgtactaactagttaattactacgtacccctaggtacggtacgtttaccgggcgtaacggggacctaagggtacggaacgttaccgaaccggtaatcgggtacggtctagtaaccc

SEQ ID NO: 216148 - DNA, 526 bp, Homo sapiens
  misc_feature: GYAE6OF02FHDW8.1.34.D01.1.454.CMB.1.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (380)..(380): a, c, t, g, unknown or other
  misc_feature (380)..(380): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggtncagcagaaaccngggcgagccccctnagactcgtagtctatggtgcatccagtatgactaaggtcgggtcccatccgaggttcagtggcagtgctatcgtgggacagattacactctcactatcancagcctgcagcctagaatatttgacttaattattactgtacaactagttaacttagtacgttaccctagttggaccgttcggccgacggggacctaagggtacggaacgtaccgaaccggtaagttcggtacggtcgtacgtaccg

SEQ ID NO: 216149 - DNA, 544 bp, Homo sapiens
  misc_feature: GYAE6OF02F9U2K.1.34.D01.1.454.CMB.1.raw
  modified_base (343)..(343): a, c, t, g, unknown or other
  misc_feature (343)..(343): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggccatcagcgattcttagcctggttgcagcagaaaccagggcgacgcccctcagatcgtagtctatggtgcatccagattgcaaggtgggtcccatccaggttcagtggcagtncatcgtgggacagtacttacactctcactatcagcacgcctgcagtcctagaagtattttgactaatttactactgtacaactagttaattatacgtacccctaggttacggtaccgttcgggaccgtaacggggaaccctaaggggtacggtaaaggtacccgtaaaccggtaacgttcgggtacggtccgtagtacccg

SEQ ID NO: 216150 - DNA, 514 bp, Homo sapiens
  misc_feature: GYAE6OF02F2AVE.1.34.D01.1.454.CMB.1.raw
  modified_base (283)..(283): a, c, t, g, unknown or other
  misc_feature (283)..(283): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcgacgcccctnagactcgtagtctagtggtgcatccagtattgcgaagggtcgggtcccagtccaggttcagtggcagtgcatcgtgggacagacttacactctacactancaagcacgcctgcacgcctagaatntttgacttaatttattactgtacaacgtattattactacgtaccctagtcggtacgttcggaccgagggaccaagggtcgaagtacaaccgtagtgcggtctgacc

SEQ ID NO: 216151 - DNA, 671 bp, Homo sapiens
  misc_feature: GYAE6OF02IP9OX.1.34.D01.1.454.CMB.1.raw
  modified_base (489)..(489): a, c, t, g, unknown or other
  misc_feature (489)..(489): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctatcggagacagagtcaccatcacttggccgggcagtcacggccatcagcgtattcttagccttggtcgcagcaacgaaaccgagggtccgacgcccctagacggtactacggtacgttctagtggtcgacctactaccagtattcggacgtaacggggttcgggtacccagttaccgtacggttacgaaggtcgggactaggtcgactagtacggtagggaactagtaactacctaacgtctacctaactataccgaacgactacgtcctcggactacgtaccgttaggtaaacgttnttttacggaactttaagttttaacttacgtacgttacctaaagttagtttaaacttaccgttaaacgttacccgttaggtacgggtaaccggtttccgggaaccgggtaacggggtaacctaacggggtaggtaaaccgtacccggtaaaccggtacggttaggtacggtactcgtaacccg

SEQ ID NO: 216152 - DNA, 496 bp, Homo sapiens
  misc_feature: GYAE6OF02FM75Q.1.34.D01.1.454.CMB.1.raw
  modified_base (298)..(298): a, c, t, g, unknown or other
  misc_feature (298)..(298): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctcagatcgtagtctatggtncatccagatttgcaaggtgggtcccagtcccaggttcagtggcagtgcatctgggacagattacactctcactatcagcagcctgcagcctgaagattttgctaatttattactgtacaanagttattanataccctacgtgacgttcggccagggaccaaggtggaagtacgaaccgtacgtggtcggtctgtaccc

SEQ ID NO: 216153 - DNA, 625 bp, Homo sapiens
  misc_feature: GYAE6OF02IED0M.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctattggagacagagtcaccattcacttggccgggcagtcaggccatcagcgtattctttagcctggttgcagcaacgaaaccgagggccgacgccccctagacgacgttcgtagttcctaagtggtgcgtactccagtatttggacgtaagggtcggggtcccctagtcccgtaggttccaggtggccaggtcgctagtcgtaggggacctaggtactttacaccgttcctacgtacttacgtcacgacgacgccgttacggactaccgtacctaggttaatacgtttttagaacttaattttacttacgttcgtaactaacttagttaacttaacgttaccgttacccgttaggtaccggtacgttccgggaccggaagggtaccgtaagggttacgaacgtaccgaacgtaacgttcggtagtcctacgtacc

SEQ ID NO: 216154 - DNA, 582 bp, Homo sapiens
  misc_feature: GYAE6OF02GDJMJ.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccngggcgacgcccctnagatcgtagtctatggtncatccagtattgacgtaagggtcgggtcccagtccgaggttcaggtggcagtgctatcgtagggacagtatttcactctacacctatcagcacgcctagcacgcctagaagtattttgactaagttactattacgtactaacgacggtaccctaacgttacgtttacccgacggttaccggttaccggacccggaaacggggtaacccgtaaaggggtaaccggaaaacccgtaaacggtaacgttacgggttaccggtaccgtacggaccctaccgtaacg

SEQ ID NO: 216155 - DNA, 536 bp, Homo sapiens
  misc_feature: GYAE6OF02HECGH.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaaggtcgggtcccatccgaggttcagtggcagtgcatcgtgggacagtacttacactctcaactatcagcagcctgcagcctagaacgtattttcgacttaattttattacttgtactaactagttaattaactaccgttacccttaggtcggtacgttcggaccggacggggtacctaagggtacggaacgtccgaaaccggtacgtggtcggacgtgacccg

SEQ ID NO: 216156 - DNA, 587 bp, Homo sapiens
  misc_feature: GYAE6OF02GACLB.1.34.D01.1.454.CMB.1.raw
  modified_base (172)..(172): a, c, t, g, unknown or other
  misc_feature (172)..(172): n is a, c, g, or t
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattgganacagagtcaccatcacttggccgggcgagtcaggccatcagcgtatttcttagcctggttgcagcaacgaaaccgagggcgacgcccctcagatcggtatctagtggtgcactccagtattggacgaagggttcggggtcccagtccgtaggttcgtacggtggcaggtcgcgtatcgtacgggacagtacttaacacttcgtacaacttatcagcacgtcctgcagtcctagaaacgtntttgacttaagttttattacgtgtactaagtattaattactacgtaccctaggtacgtacgttcggaccgtaggggaccaaagggtcgtaacgtaccgtaaccgtaacgtgggtcggtacgtcgacctaccgtattccttgtttacccttacgtaactttcccgttacccgtacc

SEQ ID NO: 216157 - DNA, 510 bp, Homo sapiens
  misc_feature: GYAE6OF02GSOGI.1.34.D01.1.454.CMB.1.raw
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcagcccctnagatcgtagtctatggtgcatccagattgacaagggtcgggtcccatccgaggttcaggtggcagtgcatcgtgggacagtacttacactctcactatcagcagcctgcagcctagagtattttgacttaatttatactgtacaactagttaattactacgtaccctagtacgtacgttcggccgagggtaccaagggtaggaacgtacaaccggtactggtcgctagacc

SEQ ID NO: 216158 - DNA, 511 bp, Homo sapiens
  misc_feature: GYAE6OF02HTLFX.1.34.D01.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
  modified_base (508)..(508): a, c, t, g, unknown or other
  misc_feature (508)..(508): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgctgggcgagtcaggccatcagcgattctttagccttggttgcagcaagaaaccagggcgacgcccctnagatcgtagtctagtggtgcatccagtattgacgaagggtcggggtacccagtccgtagggtttcaggtggcaggtgacatcgtgggacagtacttacactctacactatcagcagcctgaccagcctagaagtattttgacttaatttatactgtacaatatattatacgtaccctagtggtacgtcggccgagggacaggtagacgtcgaacgtacgtgtgntcg

SEQ ID NO: 216159 - DNA, 664 bp, Homo sapiens
  misc_feature: GYAE6OF02IACCP.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgagcccctnagatcgtagtctatggtgctatccagtattgacgtaaggggtcgggtacccagtcccgtaggttcaggtggctagtgctatcgtagggacagtactttacacttcgtacactatcgagccacgtctgaccgagccgtagtaacgttatttcgtaacttaagtttttaacttaccttacggttaacctaaacgttaagttacgttttaaacgttaccggttaaacccccgttaagggttacccgggttaaccgggttttccgggaaccccgggtaaccgggggtaacccgggtaaacggggtttaaccgggtaaaccgggttaacccgaaacccgggttaaaccggttacgggttaccggggtaccgttaccgggtaaccccg

SEQ ID NO: 216160 - DNA, 629 bp, Homo sapiens
  misc_feature: GYAE6OF02I9NCT.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctacagatcgtagtctagtggtgcatccagtattcgacgtaaggggtcgggtacccagtcccgtaggttcgaggtggcagtcgcactcgtagggacagtacttacactctcactatcacgcacgcctgcacgcctaggaagttattttgacttaaagttttacttacgttacgtacctaaacgttaagtttaaactttaacgttaacccggttaaccccgtttaacgggttacgggttaccccgggtttaccggggacccggtaacggggggtaaacccgtaaaggggttaacgggtaacggtaacccgtaaacccgggtaaccttgggtacggtaccgtaggtaaccccg

SEQ ID NO: 216161 - DNA, 585 bp, Homo sapiens
  misc_feature: GYAE6OF02IZ29Q.1.34.D01.1.454.CMB.1.raw
  modified_base (422)..(422): a, c, t, g, unknown or other
  misc_feature (422)..(422): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttaagcctggttgcagcagaaaccagggcgagcccctcagatcgtagtctaatggtgcaacgtccagacttgcaagggtcgggtcccatcctaggttcagtggctagtgacatcgtagggacagtattaacactcactactatcaagtccaagccctagacgacgacctagaaacgttnttttacgcttaaaattttacttaactgtaacctaaactagttaactttagtaaccgtaacccctaggtacggtacgttaccggaccgaacggggtaaaccgtaagggtaacggtaacgttaaccgaaacccggtaacgtacgggtacgggacttacggtaacc

SEQ ID NO: 216162 - DNA, 662 bp, Homo sapiens
  misc_feature: GYAE6OF02JYLUY.1.34.D01.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagacgagtgcgtcacgaccggtgctcgatttagatcgtctgtgttgggtttgggggtaggtcagaccctgtcaggacacagcatggacatgagggtccccgctcagctcctgggctcctgctgctctggctcccaggtaccagctgtgacatccaattgacccagtctccatccctccctgtctgcatctatgganacagatcacntcacttgccgggnagtcaggccatcagcgtattctagcctggttncagcaagaaccngggcacgcccctnagatcgtagctanggtncataccganattggacaaggggtcgggtcccaagtccgtagttacgtaggtcggactaggttgcctagttccggtaggggaacctaaggtacgtttaacaccttacgtacctaacgtaacttacgaacgcgtaacgtcccgtcgactaccgccgttaagaaacgttgtttaacgtacgttaaatttaccgttacgttacgtaactaacgttaacttaagttaaactaccgtttaaccccgtagggtttaccggtaaccggttttccgggaacccggttaacgggggtaaacccgtaaggggttaacggtaacccgggtaacctaaccggtaaccgttacggtacgggttacccgtacgggttaaccc

SEQ ID NO: 216163 - DNA, 517 bp, Homo sapiens
  misc_feature: GYAE6OF02HCRF3.1.34.D01.1.454.CMB.1.raw
  modified_base (281)..(281): a, c, t, g, unknown or other
  misc_feature (281)..(281): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatcgtgggactagattacactctacactatcagcagcctgcacgctagaagtntttgactaattttatactgtactaatagttattagtaacgttacccctaggtggtaccgttcggccgtaaggggaacctaagggtaggaacgtccgaaaccgtacgtggtcggctgaccc

SEQ ID NO: 216164 - DNA, 688 bp, Homo sapiens
  misc_feature: GYAE6OF02IR0U8.1.34.D01.1.454.CMB.1.raw
tcagacgagtgcgtcacgaccggtgctcgatttagatcgtctgtgttgggtttgggggagtcagaccctgtaaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctcagatcgtagtctagtggtgcatccagtattgacgtaagggtcggggtccctagtccgtaagggttccgaggtggctaggtcgactagttcggtaggggacctaagtaactttaaccgacctttacctaccaaccttactaccgacggtaccgaacgtcccgtaggtccaacggtcccgtaaggttaaagttactttttacggaactttaagttttaactttaaccgttagtaaccgtaaacttaagtttaactttaaacgtttaaccgttaacccccgttacgggttaccgggttaccggttccgggtaaccgggtaacggggtaacccggtaaaggggttacggtaaaccggtaacccgtaaccggtaacggttcggtaccggtaccgttacgacccgtaacccg

SEQ ID NO: 216165 - DNA, 693 bp, Homo sapiens
  misc_feature: GYAE6OF02H3HEP.1.34.D01.1.454.CMB.1.raw
  modified_base (286)..(286): a, c, t, g, unknown or other
  misc_feature (286)..(286): n is a, c, g, or t
  modified_base (340)..(340): a, c, t, g, unknown or other
  misc_feature (340)..(340): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctattggagacagagtcaccatcacttggccgggcagtcacggcatcagcgtattctttagctggttgcagcaagaaaccagggcgacgcccctnagatcgtatctatggtcgcaatccagtattagcgtaaaggtcgggtacccctanccgtaggtttcaggtcggcaggttgctaagtcgtaggggaactaggattacacttactctaactagtcagtaccacggtcctgaccgagtacccgtacgggtaaaatttagtttttacggaacctttaaacgtttttaaacgttttacccgttacggttaaacctaaaccggttaaagttttaaaccgttaaagtttaaaccccgttttaaccccggttaccgttaacgggggttaccggttacccggtaccgggttaaaccgggggaaccggtaacgggttaaacggggtaacgtaaacccggttaacccggtaaacgttacgggggttactaccggttacccgtaaacccg

SEQ ID NO: 216166 - DNA, 390 bp, Homo sapiens
  misc_feature: GYAE6OF02H1KZ4.1.34.D01.1.454.CMB.1.raw
  modified_base (376)..(376): a, c, t, g, unknown or other
  misc_feature (376)..(376): n is a, c, g, or t
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaattttattactgtcaacagtattatagtacccctagtggacgttcggccaggggaccaaggtggaagtcaacgactgtgctgcacatctgtcttcatcttcccgcatctgaacgcactcgtctgagcgggctggcaaggcncagtagnnnnnnnn

SEQ ID NO: 216167 - DNA, 619 bp, Homo sapiens
  misc_feature: GYAE6OF02F610V.1.34.D01.1.454.CMB.1.raw
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttgcagcaagaaaccgngggcgacgcccctnagatcgtagtctagtggtgcatccagtattgacgtaaggggtcgggtcccagtccgaggttcaggtggcagtgctagtcgtagggacaggtacttaccacttcacaactatcgagcacgtcctgcacgcctagtaacgttnttttacgactttaaattttacttacgttacgtactaaacgttagttaactttacgttaaccgttaccccgttagggttaccgggtaccggttaccgggaacccggtaacgggggtaacccgtaaaggggttaccggtaaacggttacccgaaacccgggttaacgttcgggtacggtaccgtacggtaccc

SEQ ID NO: 216168 - DNA, 467 bp, Homo sapiens
  misc_feature: GYAE6OF02IM1S0.1.34.D01.1.454.CMB.1.raw
  modified_base (198)..(198): a, c, t, g, unknown or other
  misc_feature (198)..(198): n is a, c, g, or t
  modified_base (443)..(467): a, c, t, g, unknown or other
  misc_feature (443)..(467): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaagggtcggggtcccatccaggttcagtggcagtgcatctgggacagattacnctctcactatcagcacgcctgcagcctagaagtattttgactaatttattactgtacaatagtaattatacgtacccctacgtcggtacggttcggaccgacggggaaccgaaggtaggaacgtacgaaccgaacgtgtcggctgacaccactctcgtcttctacttccttcccgcctactcggggggggtacaacgctactcgtcgtggacggcgggtcgtcggacgaacggcgacgtagtagnnnnnnnnnnnnnnnnnnnnnnnnn

SEQ ID NO: 216169 - DNA, 393 bp, Homo sapiens
  misc_feature: GYAE6OF02G4WX7.1.34.D01.1.454.CMB.1.raw
  modified_base (380)..(380): a, c, t, g, unknown or other
  misc_feature (380)..(380): n is a, c, g, or t
  modified_base (384)..(393): a, c, t, g, unknown or other
  misc_feature (384)..(393): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtacaactagtattatacgtacccctacgtggacgttcggccaggggaccaaggtgaagtcaaccgactgtgctgcacatctgtcttcatccttcccgcctcctcacgcactcgtctgagcgggctggcaggcanatgnnnnnnnnnn

SEQ ID NO: 216170 - DNA, 561 bp, Homo sapiens
  misc_feature: GYAE6OF02IQXZP.1.34.D01.1.454.CMB.1.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctccgtgggctcctgctgctctggctcccaggtaccagctgtgacatccaattgacccagtctccatcctccctgtctgcatctattggagacagagtcaccatcacttggccgggcgagtcaggccatcagcgtattcttagcctggttgcagcaacgaaaccgngggcgacgcccctnagatcgtagtctagtggtncatccagtattgacgtaagggtcgggtcccagtccgaggttcaggtcggcagtgcagtcgtagggacagtacttacgactctacgacttatacagcacgccgtgacagccttagaagttctttagacttaattttatacttgtaactaattagttaatttacgacgttacccgtagtggtaccgttccgggaccgaacgggtaccgtaaggtacggtaacgtaccgaaccgtaggttggtacggtacgtcgtaccg

SEQ ID NO: 216171 - DNA, 577 bp, Homo sapiens
  misc_feature: GYAE6OF02JWABX.1.34.D01.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
  modified_base (569)..(569): a, c, t, g, unknown or other
  misc_feature (569)..(569): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcagtcaggccatcagcgtttatcttagcctggttgcagcagaaccgngggccgacgcccctnagactcggtagtctagtggtnacatccagtattgacgaagggtcggtcccagtccgaggttcaggtcggcagtcgctagtcgtagggaacagtacttaccgacttctactaactatccagaccacgcctgcctacgacctagtaagttntttacgaacttatttacttactcgtaacaacgtagtttaattacgtaaccgttacccgttagtcggttacgtcgggacggtaacgggtaacgtaaggtaacggtaaccgtacgtaaaccggtagtcggtacgtacncggtaacc

SEQ ID NO: 216172 - DNA, 575 bp, Homo sapiens
  misc_feature: GYAE6OF02F26HS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggttgcagcaagaaaccgagggcgacgcccctcagatcgtagtctagtggtgcatccagtattgacgaagggtcgggtacccagtccgaggttcaggtcggcagtgcacgtcgtagggacagtaacttacacttctactaactactcgacgcacgcctgacgacgccgtagaagttacttttcgaacttaatttacttacgtgtactaactagttaattacgtaaccgttacccctaggttcggtaaccggttccggaccggtaacgggtaccgtaagggtacggaacgttaccgaaccggtacgtggtcggactcgaaccc

SEQ ID NO: 216173 - DNA, 390 bp, Homo sapiens
  misc_feature: GYAE6OF02FWU74.1.34.D01.1.454.CMB.1.raw
  modified_base (383)..(390): a, c, t, g, unknown or other
  misc_feature (383)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctacgtggacgttcggccaggggaccaaggtggaagtcaaccgactgtggctgcaccatctgtcttcatcttcccgcatctgaacgcactcgtctgagcggctggcaaggcgcatagnnnnnnnn

SEQ ID NO: 216174 - DNA, 626 bp, Homo sapiens
  misc_feature: GYAE6OF02IJ57W.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttgccgggcagtcaggccatcagcgattcttacgcctggttgcagcaacgaaaccgagggtacgacgcccctacgagactcgtaagtctaagttcggtagtcactccagtattacgacgtaaggtcgggtacccatccgtaggttcaggtggacagtgactagtcgtgggactaaggtacttacgtaacgttcctacaacgttactacgacgtcgaacgccttacggctaacgtcccgttaagaacgttagttttacgacgttaaattttactttacgtacttacctaaattagttaatttacgtaaccgttaaccccgtaagttcgggttaacggttcccggacgtaacggggaccgtaacgggtaggtaacgtccgtaaacgtaccgttaggtacggtcgtacggtaaccg

SEQ ID NO: 216175 - DNA, 551 bp, Homo sapiens
  misc_feature: GYAE6OF02IE4DN.1.34.D01.1.454.CMB.1.raw
  modified_base (297)..(297): a, c, t, g, unknown or other
  misc_feature (297)..(297): n is a, c, g, or t
  modified_base (385)..(385): a, c, t, g, unknown or other
  misc_feature (385)..(385): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctgagatcgtatctatggtncatccagattgacaagggtcgggtcccagtccgaggttcaggttggcaggtgctagtcgtagggactagacttacactctacacttancagccagcctgacgagcctagaagttatttacgacttaaatttacttacgtagtacaatagttattatacgtaaccccgttagtacggtaccgtttccggaccggtaacggggtaccaagggttacggaacgtaccgaacgtaacgtggtacggtacctgtacccg

SEQ ID NO: 216176 - DNA, 548 bp, Homo sapiens
  misc_feature: GYAE6OF02HE1NO.1.34.D01.1.454.CMB.1.raw
  modified_base (364)..(364): a, c, t, g, unknown or other
  misc_feature (364)..(364): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaagggtcgggtacccatccaggttcagtggcagtgcatcgtgggacagattacnctcacactatcagcagcctgcagcctagaagtattttcgacttaaattttacttactgtactaactattaattactaacgtaccccttaggtcggtacggtttccgggaccgtaacggggaccctaagggttacgggaacgttaccgaaacccggtaacgttcggtacgggtcctaggtacccg

SEQ ID NO: 216177 - DNA, 596 bp, Homo sapiens
  misc_feature: GYAE6OF02FSJ9P.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcgagcccctcagatcgtagtctagtggtgcatccagtattgactaaggggtcgggtacccatccgaggttcaggtcggcaggtcgctaatcgtagggaccagtactttaacaccttctaccacttatcgagaccacgcccgtcaacgcctagaagttattttcgacttaaagttttacttacttaggttaccaaacgtacgttaattaactacgtaccccgttaggttcggtaccgttccgggaccggaacgggggtaacctaacggggttaggtaaaccgtaccgtaaaccggtacgttagggtacggcttccgacgtaacccg

SEQ ID NO: 216178 - DNA, 526 bp, Homo sapiens
  misc_feature: GYAE6OF02GTB47.1.34.D01.1.454.CMB.1.raw
  modified_base (429)..(429): a, c, t, g, unknown or other
  misc_feature (429)..(429): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccaggggcgacgcccctcgagactcgtagtctatggtgcatccagattgcgaaggtcgggtcccagtccgtaggttcaggtggcagtgcatcgtgggacagattacactctacactatcagcacgcctgcagcctagaagtatttgacttaatttacttactntactaactagttaattataccgtacccgtagtcggtacgttcggccgaacgggaccgtaaggtacgaacgtacgaacggtacgtggtacgcgtgacc

SEQ ID NO: 216179 - DNA, 532 bp, Homo sapiens
  misc_feature: GYAE6OF02JERU2.1.34.D01.1.454.CMB.1.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggggagtcagaccctgtcaggacacagcatggacatgagggtcccgctcagctcctggggctcctgctgctctggctcccaggtaccagctgtgacatccaattgacccagtctccatcctccctgtctgcatctattggagacagagtcaccatcacttgccgggnagtcaggccatcagcgattcttagcctggttgcagcagaaaccagggcgacgcccctcagatcgtagtctatggtncatccagtattgctaagggtcgggtcccatccgaggttcaggtggcagtgcagtcgtgggacagtacttacactctcactatcagcagcctgcagcctagaagtattttgactaatttactactcgtactaactagttaattactaacgttacccgttaggtacggttacgttcggccgtagggaccgtaagggtacggtaacgtaccgaaccgtagttggtcggtctaggtacc

SEQ ID NO: 216180 - DNA, 552 bp, Homo sapiens
  misc_feature: GYAE6OF02HLYAI.1.34.D01.1.454.CMB.1.raw
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctagtggtgcatccagattggactaaggtcgggtcccagtccaggttcaagtggctaggtgcatcgtgggacagtacttacactctacactatcagcacgctgcacgccgtagaagtacttttnacttaatttattactagtacaactagttaattaagttacgtaaccctggtacggtacgtttaccgggacgtaacgggggtaactaacgggtacgggaacgtacgaaccggtaaccgttaggtcggtactacgtaccg

SEQ ID NO: 216181 - DNA, 405 bp, Homo sapiens
  misc_feature: GYAE6OF02IGJNY.1.34.D01.1.454.CMB.1.raw
  modified_base (388)..(388): a, c, t, g, unknown or other
  misc_feature (388)..(388): n is a, c, g, or t
  modified_base (396)..(405): a, c, t, g, unknown or other
  misc_feature (396)..(405): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagtattttgactaattttattactgtcaacagttattatacgtacccctagtggacgttcggcaggggaccaagggtggaagtcaaccgaactgtggctgcaccatctgtcttcatccttcccaccctctcacgcactcgtctgacgcgggctggacaagggcncagtacgnnnnnnnnnn

SEQ ID NO: 216182 - DNA, 522 bp, Homo sapiens
  misc_feature: GYAE6OF02GUB0B.1.34.D01.1.454.CMB.1.raw
  modified_base (300)..(300): a, c, t, g, unknown or other
  misc_feature (300)..(300): n is a, c, g, or t
  modified_base (379)..(379): a, c, t, g, unknown or other
  misc_feature (379)..(379): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccagggcgagcccctcagatcgtagtctatggtncatccagtattgcaagggtcgggtcccatccaggttcaggtggctagtgcagtcgtgggacagattacgatctcactancagcacgctgcacgtacctgaagtnttttagctaaattttactactntactaacagttaattataacgtacccgtagtcgtacgttcggacgtacgggacaagggtcgaagtaccgaaccgaagtggtacggtctacgtaccg

SEQ ID NO: 216183 - DNA, 598 bp, Homo sapiens
  misc_feature: GYAE6OF02JBCFA.1.34.D01.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcagtcaggccatcagcgtattcttagcctggttncagcaagaaaccgngggcacgccccnagatcgtagtctagtggtncatccagnttgacgtaagggtcgggtacccagtccgaggttcaggtggcagtgctagtcgagggaacagtaattacacgtctacactatcaagcagcctagcacgtccgtagtaagttattttacgactttaaagttttacttacgtagttaacctaaacgttagtttaaacttaacgtttaacccggtaccccgtttaagggtaccggttaccgggttaccggaccgggtaacgggaaccgtaagggtaccggtaacgttaccgaaaccggtagttgggtcgtacgttacgaaccg

SEQ ID NO: 216184 - DNA, 741 bp, Homo sapiens
  misc_feature: GYAE6OF02H5CG2.1.34.D01.1.454.CMB.1.raw
tcagacgagtgcgtcacgaccggtgctcgatttagatcgtctgtgttgggtttagggggagtcagaccctgtcaggacacagcatggacatgagggtcccgctcagctcctggggctcctgctgctctggctcccgaggtaccagctgtgacatccaattgacccagtcctcactccctcctgtctgtcatctattggagacagacgtcacctatcacttcggaccgggtcgacgtacgaacggtccaatcgaacgtcgtaactttacgtttaacggtaccgttggttacgcgacggtacgaaaccggaaaacccgacggggtacccgtaaccggccccccttacgtaacgtacgttaccggtagtttaccctaaggttcgggtactaccgtaactaaccggtaacggtacgttcggaccggttaacggggttaccgggtcccctaaggttccggtagggtttaccgagggtacggacgtaggtacgtactacggttaccgtagggaacctagtacttacctacgttacctactacctagtcgtacgtacctaggtacctcggtactacgtacgtagttaacgtagtttacgtaacttaacgttttataccgttaaccgtacgtaacgttacgttaacgttacgtaaccgtacccgtacggtacggtaaccgtacggaccggtaacgggtacaacgggttgaaccgttcgaaacgtccgttggtaccgtacgtaccgtacg

SEQ ID NO: 216185 - DNA, 576 bp, Homo sapiens
  misc_feature: GYAE6OF02J23FS.1.34.D01.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (549)..(550): a, c, t, g, unknown or other
  misc_feature (549)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(560): a, c, t, g, unknown or other
  misc_feature (556)..(560): n is a, c, g, or t
  modified_base (562)..(565): a, c, t, g, unknown or other
  misc_feature (562)..(565): n is a, c, g, or t
  modified_base (567)..(569): a, c, t, g, unknown or other
  misc_feature (567)..(569): n is a, c, g, or t
  modified_base (571)..(576): a, c, t, g, unknown or other
  misc_feature (571)..(576): n is a, c, g, or t
tcagacgagtgcgtcacgaccggtgctcgatttagatcgtctgtgttgggtttgggagtcgaggccatcagcgattctttagcctggttgcagcagaaaccgagggcgacgccctcagatcgtagtctatggtgcactccagtattcggacgtaagggtcgggtcccatccgtaggttcagtcggcaagtcgactagtcgnggacagtattaccnctctcactancagcacnctgcacgctaggtaacttgtttacacttaaattttctcgtacaactactagtttattaaaccgtaccgtaccccgttaggtacgggtacgttaccggccggaagggacctaaaggtcgtaaaccggaccaacggtacgtggtacggtctaacgcctaaccttaggtctacgtttaccaccgtaccttccccggtccacttacgtcgaaccggaccctcgttccgttacgccggtaagccgggtcggtaccgcggtaaccgacggcctagaagtcgcacngtacncgcntacgngtncncncnncncnctcncncgcnncncncnnnnncnnnncnnncnnnnnn

SEQ ID NO: 216186 - DNA, 532 bp, Homo sapiens
  misc_feature: GYAE6OF02GJVEQ.1.34.D01.1.454.CMB.1.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttncagcagaaaccgngggcgacgcccctgagatcgtagtctagtggtgcatccagattgcgaagggtcgggtcccagtccgaggttcagtggcagtgcatcgtgggacagtatacactctcactatcancacgctgcagctgaagtntttagcttaatttctactgtacaatagttaattactaacgtacccttaggtacggtaccggttcggaccggtaagggtacctaagggtaggtaacgtaccgaaccggtaagtggtacggtctagaccc

SEQ ID NO: 216187 - DNA, 504 bp, Homo sapiens
  misc_feature: GYAE6OF02G00FW.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatcgtggacagattacactctcactatcagcagcctgcagcctagaagtatttgactaatttattactgtacaatagtattatacgtaccctagtaggtacgttcggaccgacggggactaaggtgaagtccgaacgtacgtggtggctgcaccgatcgtcgttcttcacttccgtcccgtacc

SEQ ID NO: 216188 - DNA, 502 bp, Homo sapiens
  misc_feature: GYAE6OF02FGMAM.1.34.D01.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (375)..(375): a, c, t, g, unknown or other
  misc_feature (375)..(375): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccngggcacgcccctnagatcgtagtctatggtgcatccagattgcgaagggtcgggtcccatccaggttcagtggcagtgcatcgtgggacagattacactctcactancagcagcctgcagcctagaagtattttgacttaaatttattactgtacaactagtattaatacgtacccctagtgacgttcggaccgagggaccaaggtcgaagtcgaacgtaactgtacgctgacc

SEQ ID NO: 216189 - DNA, 405 bp, Homo sapiens
  misc_feature: GYAE6OF02FMV58.1.34.D01.1.454.CMB.1.raw
  modified_base (384)..(405): a, c, t, g, unknown or other
  misc_feature (384)..(405): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgcaatttattactgtcaacagtattatagtacccctacgtggacgttgccagggaccaagtggaagtcaaccgaactgtggctgcaccatctgtcttcatccttcccgccatctgaacgcactcgtctgagcgggctggcaaggcacagtagnnnnnnnnnnnnnnnnnnnnnn

SEQ ID NO: 216190 - DNA, 558 bp, Homo sapiens
  misc_feature: GYAE6OF02HHOMQ.1.34.D01.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (417)..(417): a, c, t, g, unknown or other
  misc_feature (417)..(417): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcagaaaccagggcgaggcccctnagatcgtagtctagtggtgcatccagattgcgaagggtcgggtcccagtccgtaggttcaggtggctagtgactagtcgtaggggacaaggtatttaccactctacactatcagccagcctgccacgctagaagtnttttagacttaattttactacttcgtactaactagttaacttaacgtaacgttaccccgttaggtacggtacggttccgggaccggagggtaaccgtaagggtacggaacgtacgtaaccgacgttggacggtctcgaccg

SEQ ID NO: 216191 - DNA, 545 bp, Homo sapiens
  misc_feature: GYAE6OF02H9X9M.1.34.D01.1.454.CMB.1.raw
  modified_base (281)..(281): a, c, t, g, unknown or other
  misc_feature (281)..(281): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgattctttagcctggttgcagcagaaaccgagggcgagcccctnagatcgtagtctatggtgcatccagattgacgtaaggtcgggtacccagtccgaggttcaggtgcnggtncatcgtgggacagtatacactcgtcactancacgcacgcctgccagcctagtaagtnttttacgacttaattttactacttgtactaaagtagttaattataccgttacccgtagtacggtaccgttcggccgaacggggtaccaagggtacgaacgttacgaaccgtacgttcggtcggtaccgtgtaacccg

SEQ ID NO: 216192 - DNA, 644 bp, Homo sapiens
  misc_feature: GYAE6OF02JEA8A.1.34.D01.1.454.CMB.1.raw
  modified_base (301)..(301): a, c, t, g, unknown or other
  misc_feature (301)..(301): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatccattggagacagagtcaccatcacttgccgggcgagtcaggccatcagcgattctttagcctggttgcagcagaaaccgagggcgacgcccctcagactcgtagtctagtggtncatccagtattcgcgaagggtcgggtacccagtcctaggttcaggtcggctagtcgctagtccggtgggaactaggtactttacacgttctacaacgttactcgaacgcctacgccgttagccgtacgtccgtaggtaaagttacgtttacggaactttaagttttaccttaacggttataaccgttaaacttaacggttttaaactttacgtaacccggtttaaaccccggttaaggttaccggggttaaccgtttaccggggaacccgggtaacggggtaaccgttaaagggtcggtaaacgtacccgtaacggtaaccgtggtacggcgttcgtaacccg

SEQ ID NO: 216193 - DNA, 560 bp, Homo sapiens
  misc_feature: GYAE6OF02HM1DA.1.34.D01.1.454.CMB.1.raw
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
  modified_base (465)..(465): a, c, t, g, unknown or other
  misc_feature (465)..(465): n is a, c, g, or t
  modified_base (513)..(513): a, c, t, g, unknown or other
  misc_feature (513)..(513): n is a, c, g, or t
  modified_base (545)..(545): a, c, t, g, unknown or other
  misc_feature (545)..(545): n is a, c, g, or t
tcagacgagtgcgtcacgaccggtgctcgatttagatcgtctgtggttaggggtttgggggagtcagaccctgtcaggacacagcatggaccatgaggtccccgctcagctcctgggctcctgctgctctggctcccaggtaccagctgtgacatccaattgacccagtctccatcctccctgtctgcactctattggagacagagtcaccatcacttgccgggacgagtcacggccatccagcgtattcttagccttggtgcagcaacgaaaccgagggcacgcccctanagtactcgtagtcctagtcggtnctacgtcccaagtacttggacgtaaggggtcggggtacccagttccgaggttcgaaggtcggactagtcgctatcgtagggaccagtactacactactcactancagtcatccngacagaccttagaacttnttagacttaatttagtacngtactaagtcttattacgtacgtacccgtagcggtaccggtcgacggnggtaacgtaacggtaggaacgtcaaccggtancggtcgacgtgtacc

SEQ ID NO: 216194 - DNA, 671 bp, Homo sapiens
  misc_feature: GYAE6OF02JJS28.1.34.D01.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagccgtggttcgcagcaagaaaccgagggcgacgcccctnagactcgtagtctagtggtgctactccgaagtagttggacgtaaggggtcgggttccccaatccgtaggttcaggtcggctacggtgtacagttcgtagggaactaggtacttaaccactcgtacaactagtcaacgctacgccctaggacctacggtaccctaggtaaacgtttacgttttaacggaactttaaacgttttacttaaccgtacgttaacctaaacgtaaggttttaaacttaacgttaaccgttaaccccgttacgggtacgggttacccgtttaccgggacccggtaaacggggtaaccgtaaacggggttacggtaaaccggttacccgtaaaccggtaacgttcgggtaccggttacgtcggtaacccg

SEQ ID NO: 216195 - DNA, 561 bp, Homo sapiens
  misc_feature: GYAE6OF02H77C1.1.34.D01.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggtncagcagaaaccagggcgagcccctnagatcgtatctatggtncatccagattgcgaaggtcgggtcccatccgaggttcaggtggcagtgcatcgtgggacagtatacnctctcactancagcagcctgcagcctagaagtatttagacttaatttattactagtacaactagttattactacgtaccccgttaggtcggtacgttcggaccgaacggggtaccaaagggtacggtaacgtaccgaaccgtacgtcggtcggacctaggaccctaaccgtagttaccgttcggttaccctttaccgtactttccccgttccccgtacccccg

SEQ ID NO: 216196 - DNA, 501 bp, Homo sapiens
  misc_feature: GYAE6OF02H2TM4.1.34.D01.1.454.CMB.1.raw
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcgaaggtcgggtcccatccgaggttcagtggcagtgcatcgtgggacagtattacactctcactancaagcagcctgcagcctgaagtatttgataattatactgtacaatagtattatacgtacccgttagacggtacgttcggactacgggaaccaaggtaggaacgtacgaacgactggtagctgacc

SEQ ID NO: 216197 - DNA, 497 bp, Homo sapiens
  misc_feature: GYAE6OF02G01J3.1.34.D01.1.454.CMB.1.raw
  modified_base (281)..(281): a, c, t, g, unknown or other
  misc_feature (281)..(281): n is a, c, g, or t
  modified_base (402)..(402): a, c, t, g, unknown or other
  misc_feature (402)..(402): n is a, c, g, or t
  modified_base (495)..(496): a, c, t, g, unknown or other
  misc_feature (495)..(496): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgacaagggtcgggtcccatccgaggttcagtggcaggtgcatcgtgggacagattacactctacactatcagcacgcctgccagctagaagtnttttgacttaatttattactgtacaatattattatacgttaccctagtcgtacggttcggccgagggaccgaaggtgaagtacacgatgtgcnnc

SEQ ID NO: 216198 - DNA, 704 bp, Homo sapiens
  misc_feature: GYAE6OF02H73PI.1.34.D01.1.454.CMB.1.raw
  modified_base (200)..(200): a, c, t, g, unknown or other
  misc_feature (200)..(200): n is a, c, g, or t
  modified_base (325)..(325): a, c, t, g, unknown or other
  misc_feature (325)..(325): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatcctccctgtctgcatctagttgganacagacgtcaaccatccacgttcggccgggcgagtcaggccaagtcagcgtatttactttacgtcctggttcgcagcaagaaaccgagggacgacgccccgcgagtactcgtagtactagtggtnactactccaagtattaggacgtaaggggtccgggtacccaagtccgaaggttcgaaggtcgggactagtcgactacgttcggtagggaacaggtaactttaacctaccttccttacgtacttaacgtacctacgccgtaacggtccttacggacctaaacggtccgttaaagtaacgttacttttacggaactttaaacgtttttaacttaccgtacgttaacaacgttaaagtttacttaaacgtttaaccgttaccgttaccgttaccggtttcgggtaacccggtttccgggaacccggtacgggggtaaacccgttaagggtacgggtaaacgtaccgtaaacccggtaacgttacgggtacggtacgtacccgg

SEQ ID NO: 216199 - DNA, 610 bp, Homo sapiens
  misc_feature: GYAE6OF02FWXSO.1.34.D01.1.454.CMB.1.raw
  modified_base (295)..(295): a, c, t, g, unknown or other
  misc_feature (295)..(295): n is a, c, g, or t
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccggcgagtcaggccatcagcgattcttagcctggttgcagcagaaaccagggcgagcccctcagatcgtagtctatggtncatccagtattgctaaggtcgggtcccatccgaggtttccagtcggcaggtgctagtccgtggggacctaggtacttaacgacttcgtactaacttatacgagccgagcccttggccagccttagaaagtattttagacttaaattttacttacgtaccgttactaaccgttaagttaactttaactaacggtttaaccccctaggttccgggtaacgtttaccggggtcccgtaaggggtaacccggtaagggttacggtaacggtacccgtaaaccggtaaaccggttggttaccggtacgtccggtaacccg

SEQ ID NO: 216200 - DNA, 504 bp, Homo sapiens
  misc_feature: GYAE6OF02FPQTT.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctnagatcgtagtctatggtgcatccagattgcaagggtcgggtcccagtccaggttcacggtggcagtgcagtcgtgggacagattacactctcactatcagcagcctgcagcctagaagtattttgacttaatttattactgtacaactagttaattatacgtaccctaggtcgtacgttcggacgagggaccaaggtcgaagtcaaccgtagtggcggctgacc

SEQ ID NO: 216201 - DNA, 780 bp, Homo sapiens
  misc_feature: GYAE6OF02FW9FF.1.34.D01.1.454.CMB.1.raw
  modified_base (331)..(331): a, c, t, g, unknown or other
  misc_feature (331)..(331): n is a, c, g, or t
tcagacgagtgcgtcacgaccggtgctcgatttagatcgtctgtgttgggtttgggggtaggtcgagaccctgtcaggacacagcatggacatgagggtcccgcgtcagctcctcggggctcctgctcgctctggctcccaggtacccagcctgtgacactcctaattcgacccagtcctccacttccctccctcgttctcgtccactctatttgggaagtacagagtccaaccataccaccgtttgacccggggtcgaggtccaggcccaatccgagccgattctttagccgttggttacgtctaggctaagaaacccaggggcggaacnccccctagacgactacgtacgtctaagtcggtacgctaatccgagacttgacaaggggttcgggtacccatcccgagggtttaccaggttcggctacggtagcaacttggtacgggacaggtaacgttaactaccgtactactaacgttactacgtaacgcaacggtcctagtaccaacggtaccgtacgaaacgttactttttaacggaactttaaacttttaacgttttaaaccgttacgtttaacgtaaaccttaaacgggttaaattttaacggtaaaacgttttaacccccctttaaagggttacccgggttaaaccggttaccggggtttaaccccgggtaaaccggggtaaaccgggggtaaaccggttaaacggggtaacgggttaaacccgtaaacccgggtaaaacgtacggttacggggtaaccggttcgaaacccgg

SEQ ID NO: 216202 - DNA, 597 bp, Homo sapiens
  misc_feature: GYAE6OF02GZ3VA.1.34.D01.1.454.CMB.1.raw
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (443)..(443): a, c, t, g, unknown or other
  misc_feature (443)..(443): n is a, c, g, or t
tcagacgagtgcgtcacgaccggtgctcgatttagatcgtctgtgtttggggttttggggggagtcagacccgtcgtcgaggacaccaggcaagtggactactgagggtcccgctcagctccgtgggctcctaggctgctcgtggctcccaggtaccagctgtgacatccaattgacccagtctccatcctccctgtctgcatctattgganacagagtcaccatcacttgccggggnagtcaggccatcgagcgtattctttagcctggttgcagcaggaaaccagggcacgcccctnagatcgtagtctagtggtgcatccagtattgacaagggtcgggacccagtccgaggttcagtcggcgagtgctagtcgtgggactaggtattaacactctctactactgacgtacacgtccctgactcgacctagtaaacgttnttttagacttaaagtttttatacgttacgtactaaacgtagtttaacttaacgtaaccgtttaacccgagttacggttaccggttcgggacccggtaacgggtaacctaaggggtacgtaacgtaccgaaccgtacgtggtacgcgtatacccg

SEQ ID NO: 216203 - DNA, 480 bp, Homo sapiens
  misc_feature: GYAE6OF02HCL44.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagatttgactaatttattactgtacaacagtattatagtacccctagtggacgttcggcgagggacaggtgaagtcacgactgtggctgcacatctgtcttcactcctcccgtccc

SEQ ID NO: 216204 - DNA, 607 bp, Homo sapiens
  misc_feature: GYAE6OF02HN5R5.1.34.D01.1.454.CMB.1.raw
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattgganacagagtcaccatcacttgccggcgagtcaggccatcagcgtattctttagcctggttgcagcaagaaaccgagggcgacgcccctcagatcgtagtctagtggtgcatccagtattgactaagggtcgggtcccagtccgaggttcagtggcgagtgcagttcgaggggacaggtaatttaaccgacttacctactaacttactacgagccaacggcctagacctacgcctagtaaagtactttttcgacttaattttacttacgtacgtactaaacgttattaactttacgtaaccgttacccgtagttacggttaccggtttaccgggaccggtaacggggtaaccgtaagggttaccggtaacgtaccggaaaccggtaacgttcggtacggtcgtacggtaccc

SEQ ID NO: 216205 - DNA, 490 bp, Homo sapiens
  misc_feature: GYAE6OF02JI5AU.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcagcccctnagatcgtagtctatggtgcatccagattgcaaggtgggtcccatccgaggttcagtggcagtgcatcgtgggacagtattacgactctcactatcagcacgcctgcagcctagagtatttgctaatttactactgtacaatagttattatacgtaccctagtgtacgtcgcgaggtaccaaggtgaacgtacaaccgatggcgtctgaccg

SEQ ID NO: 216206 - DNA, 575 bp, Homo sapiens
  misc_feature: GYAE6OF02GNQRC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctagtggtgcatccagtattgacgaagggtcgggtacccatccaggttcagtgggcaggtgctagtcgtgggacaggtattaaccacttctcaactactacgacgcacgcctgcagcctaggtaatacttttagacttaaattttacttacgttacgtactaactaagttaattacttaacgttaacccctacgttacgggtaccgttaccgggtaccgaacggggtaccgaagggttacgggaacgttaccgaaccggtaacgtcggtacggtactacgaccg

SEQ ID NO: 216207 - DNA, 557 bp, Homo sapiens
  misc_feature: GYAE6OF02IV0BU.1.34.D01.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcacgaaaccaggggcgagccccctnacgatacgtagtctactggtgcatccagattgacaaggtgggtcccatccgaggttcagtcggcagtgcatcgtgggacagtattacactctactatatcacgcacgtcctagcgagtccctagaagttactttaggacttaagtttacttactagttacaacgtaagttattagtacgttacccgtacgtaggaccgttcggaccggtaacgggtaccgtaaggtacggtaaggtaccgtaaccggaacgtcggtacggtactccgtaccgg

SEQ ID NO: 216208 - DNA, 518 bp, Homo sapiens
  misc_feature: GYAE6OF02G8JRL.1.34.D01.1.454.CMB.1.raw
  modified_base (256)..(256): a, c, t, g, unknown or other
  misc_feature (256)..(256): n is a, c, g, or t
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
  modified_base (511)..(511): a, c, t, g, unknown or other
  misc_feature (511)..(511): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttcncagcagaaaccagggcacgccctcagagtcgtagtctagtgtgcanccagattgacgaagggtcgggtccatccgaggttacagtcggcagtgctatcgtgggacagtacttacactcgtactactatcgagcacgcctgctancctagattatttcgaacttatttatactcgtacaactattattactacgttaccctagtcggtacgtcggacgtacgggaactagggtagaacgtcgaacggtgtgacggntacgacc

SEQ ID NO: 216209 - DNA, 505 bp, Homo sapiens
  misc_feature: GYAE6OF02FKU93.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgcaaggtggggtcccatccaggttcagtggcagtgcatctgggacagattacactctcactatcagcagcctgcagcctagaagtattttcgactaattttattactgtacaacagttattactacgtacccctagtcggtacgttcggacgaggggaccaagggtcgaacgtccaaccgactggtcggctgctacgatctcgtcttcactccttccgac

SEQ ID NO: 216210 - DNA, 557 bp, Homo sapiens
  misc_feature: GYAE6OF02I3U57.1.34.D01.1.454.CMB.1.raw
  modified_base (304)..(304): a, c, t, g, unknown or other
  misc_feature (304)..(304): n is a, c, g, or t
tcagacgagtgcgtcacgaccggtgctcgatttagatcgtctgtgttggggtttgggggagccagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccgagggcgacgcccctcagactcgtagtctagtggtncatccagtattgacgaagggtcgggtcccagtccgtaggttcagtggcagtgacagtcgtagggacagtactacactctactactatcacgcacgtcctgacacgccgtagaagttatttgacttaatttacttactgtacaactagttaacttacgtaccgtaccctaggtcgtaccggttcggaccggtagggaaccgtaagggtaggtaacgtaccgaaccggtaaggttcggtacggtaccgtagtacc

SEQ ID NO: 216211 - DNA, 511 bp, Homo sapiens
  misc_feature: GYAE6OF02GVO27.1.34.D01.1.454.CMB.1.raw
  modified_base (247)..(247): a, c, t, g, unknown or other
  misc_feature (247)..(247): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (423)..(423): a, c, t, g, unknown or other
  misc_feature (423)..(423): n is a, c, g, or t
  modified_base (444)..(445): a, c, t, g, unknown or other
  misc_feature (444)..(445): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
tcagacgagtgcgtcacgaccggtgctcgatttagatcgtctgtgttggggttgggagtcacggccatcaggcgtattcgtttagcctggttgcagcagaaaccaggcgagcccctcagatcgtagtctagtggttgcatccagtagtttgcgaaggtcgggtcccataccgaggttcagtggcagtgcatcgtgggacagacttacgacgtctctactatcgagccaggcctgcacgcctgaagtntttgctaatttatacgtcgtcaacagtattatacgtaccctagtggacgttcggaccgacgggaccaaggtggaacgtcgaaccggatggngcngcactatctgtcctcngtcctcccgctatctagaacgtctacgtcgcgtgtagccggtatcggacaaggtcgataagtacgngacactgctagctagactganncngngngcngcgcgcncntntcgtgtngngntacactacgacgcgtcgacgacganacncgngtcg

SEQ ID NO: 216212 - DNA, 576 bp, Homo sapiens
  misc_feature: GYAE6OF02GGO5N.1.34.D01.1.454.CMB.1.raw
  modified_base (280)..(280): a, c, t, g, unknown or other
  misc_feature (280)..(280): n is a, c, g, or t
  modified_base (389)..(389): a, c, t, g, unknown or other
  misc_feature (389)..(389): n is a, c, g, or t
tcagacgagtgcgtcacgaccggtgctcgatttagatcgtctgtgttgggtttgggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaagaaccagggcgacgcccctnagatcgtagtctagtggtcgcatccagtattgacgtaagggtcgggtcccagtccgaggttcaggtggacagtgacagtcgtagggacagtacttacactctacaactnacagcacgtcctgcagtccgtagtaagttattttcgactttaaatttacttacgtagtaactaaacgttagttaaatttaacgtaaccgttaccccttaggttcggtacccggttcggaaccgggtaacgggaccgtaaagggtacggaacgtaaccgaaccggtacgttaggtcgtacgtgacccg

SEQ ID NO: 216213 - DNA, 557 bp, Homo sapiens
  misc_feature: GYAE6OF02G111T.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaaggtgggtcccatccaggttcagtggcagtgcatcgtgggacagattacactctcactatcagcagcctgcagcctagaagtattttgactaattttacttactgtacaactagttaatttaactaacgttaccccgttagttcggtaccgtttccgggaccgaagggggtaaccctaaaggggttacggaaacgttacccggaaaccggtaacgttacgggttacggtaccgtaggtaaccccg

SEQ ID NO: 216214 - DNA, 573 bp, Homo sapiens
  misc_feature: GYAE6OF02HDI91.1.34.D01.1.454.CMB.1.raw
  modified_base (305)..(305): a, c, t, g, unknown or other
  misc_feature (305)..(305): n is a, c, g, or t
  modified_base (411)..(411): a, c, t, g, unknown or other
  misc_feature (411)..(411): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcgagtcaggccatcagcgatttctttagccttggttgcagcaagaaaccgagggccgacgccccctcagatcgtagtctatggtncatccagattggacgtaaggggtcgggtaccccagtaccgtaggttcaggtggctagtgctagtcgtgggaacaggtacttaccactctacactatcagcacgctncgagctagaacgttatttacgacttaattttattacgtagtacaactagttaattaactaccgttaacccgtagttacggtaccggtttacgggccggtaacgggtaaccgaagggttacggaacgtaaccgtaaccgtacgtacggtacggtctagtaccg

SEQ ID NO: 216215 - DNA, 672 bp, Homo sapiens
  misc_feature: GYAE6OF02H8Q96.1.34.D01.1.454.CMB.1.raw
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (658)..(658): a, c, t, g, unknown or other
  misc_feature (658)..(658): n is a, c, g, or t
tcagacgagtgcgtcacgaccggtgctcgatttagatcgtctgtgttgggtttgggggagtcgagacctgtcaggacacagcatggacatgagggtccccgctcagctctgggctcctgctgctctggctcccaggtaccagctgtgacatccaattgacccagtcctccatcctccctgtctagcattctagttggagacagacgtcaacatcacttggccgggcagtccgaaggccatcgagcgaattctttagccttggttncgagcacggaaaccgngggtaccgacgcccctacacgactacgtacgtctaagttggtcgcatcccgagtattggactaaagggttccggggccctagtcccgtaaggtttcaaggtcggcgacggttcgcgaacttcgcgggaacgagtaacgttactaccttacgttacaacttataccgagacgtacgtcccttggaaccgacgtcgtaacgtaaagttagtttacggtaacttaaattttagttaccttagtaccgaaaacctttaggttaaatttaacgttaaccgttaacccctttaacgggtcggttaaccggtttccggaaccggttaaccggggacgtaaaccgggttggtaacgttaccgaaacggtaaccgttacgggttanccggtattacccgg

SEQ ID NO: 216216 - DNA, 539 bp, Homo sapiens
  misc_feature: GYAE6OF02GBBY0.1.34.D01.1.454.CMB.1.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatccagcgattcttagcctggttgcagcagaaaccgngggcgacgcccctnagatcgtagtctatggtgcatccagattgacgaagggtcgggtcccagtccgaggttcaggtcgcagtgcatcgtgggacagtactacactctcactatcagcacgctgcacgcctagaagttnttttacgacttaaatttacttactgtactaactagttaattaactaccgtacccttaggtacggtacgttcggacgaagggaaccgtaagggtacggtaacgtaccaaccggtagtacggtcggactagacc

SEQ ID NO: 216217 - DNA, 478 bp, Homo sapiens
  misc_feature: GYAE6OF02JYPBO.1.34.D01.1.454.CMB.1.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (455)..(458): a, c, t, g, unknown or other
  misc_feature (455)..(458): n is a, c, g, or t
  modified_base (460)..(461): a, c, t, g, unknown or other
  misc_feature (460)..(461): n is a, c, g, or t
  modified_base (463)..(463): a, c, t, g, unknown or other
  misc_feature (463)..(463): n is a, c, g, or t
  modified_base (466)..(478): a, c, t, g, unknown or other
  misc_feature (466)..(478): n is a, c, g, or t
tcagacgagtgcgtcacgaccggtgctcgatttagatcgtctgtgttgggtttgggtagtcaggccatcagcgattctttagtcctggttgcagcagaaaccaggcggagccctccagatcgtagtctatggtgcatccagattgcaaggtgggtcccatccaggttcagtggcagtgcatctgggacagnttacacncttcactatcagcagcctagcagcctgaagacttttgctaatttattactgtacaacagttattactagtaccccttacgtaggacgtttcgacccggtaggggaacccaaggtggtaacgtcctaaaccggaaaccttggtacggcgtggacaacccgattacgtgttcttcaagtttcctcccggacctatacgttcgaacgactaccgttcttccgtagacgccgggtctaggcaaacgggtcgcctaagtagnnnngnnangtnnnnnnnnnnnnn

SEQ ID NO: 216218 - DNA, 646 bp, Homo sapiens
  misc_feature: GYAE6OF02GA85W.1.34.D01.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccgtggttgcagcagaaaccagggcgacgcccctnagatcgtagtcctatggtgctatccagattgcgtaagggtcggggtacccagtccgaggttcgaggtggcaggtgacagttcgtacggggaacagtaacttaacgaccttctacgtaacctatacacgctacggcccttagacgacggtcctaggtaaacgttagtttttagacgtttaaaattttactttacgtacgttaacctaaacttaagttaatttaacgttaaccgttaacccccttaagggtttacgggtaccggttaccggacccggtaacggggtacccggtaaaggggtaccgggtaaaccgttaccgaaacccggttaaccgttagggtacggttaccgtaccgtaacccg

SEQ ID NO: 216219 - DNA, 921 bp, Homo sapiens
  misc_feature: GYAE6OF02I4SMQ.1.34.D01.1.454.CMB.1.raw
  modified_base (603)..(603): a, c, t, g, unknown or other
  misc_feature (603)..(603): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatcctaattcgacccagtcctccactccctccgtgtctgacatctagttgagacagagtcaccatcacgttcggccgggacgtacgtacgaagggccctaagtaccgaggtaccgttagttttaccgttttaacggtcccgtttggggtttcgacgtaacggtaccgtaaaacgggaaaaaccccggacgggggtaccccggtaaacccggcccccccttaacgaagggttaaccgttaccggtttaacggttaccgtttaaggtcggggttacaccgtaacgttacccgtaaggttacgtttacgggaaccggttaaacggggtccgggtaccctaacgtccggtaacggtttccggaaggttacggggcctaaggggtacctacgtaacgttcggtaacggggaactaacggtactttaaacccgtacgttaccgttaacaaccgtttaanccggaacgttaccgaaccggtcccttacggacgaaccggttccttaaaggtaaacgttttatttaaccgtaacgttttaactttttaccgttaaacgttcgtaaacccgttaaacgtttacgttaaccgttttaaaacggtaaccccgtttaaaccccgggttaggggttacccggttaccgggtttaacccggggtaaccggtaaaaccggggttaaccggtttaaacgggggaacggttttaaaacccgggttacccgttaaaaaccgggttaaccggttaccgggtttacgggtacccggtttaacccggaaccc

SEQ ID NO: 216220 - DNA, 668 bp, Homo sapiens
  misc_feature: GYAE6OF02GY8S5.1.34.D01.1.454.CMB.1.raw
  modified_base (197)..(197): a, c, t, g, unknown or other
  misc_feature (197)..(197): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgtattcttagcctggttgcagcaagaaaccagggcgacgcccctgagatcgtagtctagtggtgcataccagattggacgtaaggggtcgggtacccagttcccgtaaggttccaggtcggtacaggttcgacagttcggtagggaactaggtaacttacacgttcctacaacgttatccgagacctaacggcccttaggaccctacggacccttagggaaacgttagtttttacggaactttaaagttttactttacgtacgttaacctaaagttaagtttaactttaacgttaacccgttaccccgttaagggttccgggttaaccggtttcccgggaacccggtaacgggggtaaaccctaaaggggtacgggtaaacgttacccgaaacccggtaacgttacgggtaccgggtacgtacgtaacccg

SEQ ID NO: 216221 - DNA, 540 bp, Homo sapiens
  misc_feature: GYAE6OF02G38W0.1.34.D01.1.454.CMB.1.raw
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccaggcgagcccctcagatcgtagtctatggtgcatccagattgacaaggtcgggtcccatccgaggttcagtggcagtgcatcgtgggacagtattacactctcacggtatcgagcagcctgcagcctagaagtntttagacttaatttatacgtgtacctaactagttaattactaacgttacccctaggttcggtaccgttaccgggccggtaacggggacctaaagggtcgaaacgtccgaaacccggtagtcggtacggtctaggtaccc

SEQ ID NO: 216222 - DNA, 391 bp, Homo sapiens
  misc_feature: GYAE6OF02IO69P.1.34.D01.1.454.CMB.1.raw
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
  modified_base (381)..(391): a, c, t, g, unknown or other
  misc_feature (381)..(391): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgagtatttgctaatttattactgtcaacagtatatacgtacccctagtggacgttcggccaggggacaggtggaagtcaaccgatgngctgcacatctgtcttcatccttcccgctatctgaacncactcgtctgaggcgggctggcaaggcgcatagnnnnnnnnnnn

SEQ ID NO: 216223 - DNA, 598 bp, Homo sapiens
  misc_feature: GYAE6OF02JHW1Z.1.34.D01.1.454.CMB.1.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatccctccctgtcctgcatctattggagacagagtcaccatcacttgaccgggcagtcaggccatcagcgattcttancctggttncagcagaaaccngggcgagcccctanagatcgtatcctatggtcgctatccagtacttgctaagggtcgggtacccatccgaaggttcaacggnggtccaagtgacagtcgtagggacaggatttaaccacttcgtacacttaactcgaagccaagtccctgacctacggacccttaggtaaagttacgtttttagaccttaaagtttttacttacccgttagttaaccaaaccttggtttaacttacgttaaccgtaaccccgttagttacggtaccgttcggaccgtacgggtacaagggttacgaagtaccaacgttaaccgtggtacgacttacgaccg

SEQ ID NO: 216224 - DNA, 497 bp, Homo sapiens
  misc_feature: GYAE6OF02G0QP6.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaatttattactgtacaactagtattatagttaccctacgtggacgttcggccgaggggtaccaaggtggaagtacgaaccgaactaggtggctgccg

SEQ ID NO: 216225 - DNA, 723 bp, Homo sapiens
  misc_feature: GYAE6OF02FS0X7.1.34.D01.1.454.CMB.1.raw
  modified_base (76)..(76): a, c, t, g, unknown or other
  misc_feature (76)..(76): n is a, c, g, or t
  modified_base (169)..(169): a, c, t, g, unknown or other
  misc_feature (169)..(169): n is a, c, g, or t
  modified_base (245)..(245): a, c, t, g, unknown or other
  misc_feature (245)..(245): n is a, c, g, or t
tcagacgagtgcgtcacgaccggtgctcgatttagatcgtctgtgttgggtttggcatggacatgagggtccccgntcagctcctgggctcctgctgctctggctcccaggtaccagctgtgacatccaattgacccagtctccatcctcctgtctgcatctattgganacagagtcaccatcacttgccgggcagtcaggccatcagcgtattctttagccgttggttgcagcagaaaacccgngggccgaacgcccctgaacgatcggtaagtctaagtcggttgcctagttccgagtacttcggacgtaaaggggttccgggtaccccagttcccgtaagggtttcaaggttcggactaaggttcgacgtagttcgtacggggactaggtactttaccgacttacctacgtaacgttacgtcgaacgtccgtaacgtcccgtagaccgttacgtacccgttaggaaactttacgtttacgacctttaaacgttttacgttaacgtcgttaaacctaaacgtaagtttacgtactttaaccggtaacccgttacggttccggtaaccggtttaccggaccgaacggggttaaacctaacgggttaacgtacgttaacccgtaacggtagtttaccgggtacgttaccgtaccgaccgttaacgttaccggttccgttagggttttaccctaccggtacgtttaccccgtttaccggaaccg

SEQ ID NO: 216226 - DNA, 559 bp, Homo sapiens
  misc_feature: GYAE6OF02ILJMU.1.34.D01.1.454.CMB.1.raw
  modified_base (281)..(281): a, c, t, g, unknown or other
  misc_feature (281)..(281): n is a, c, g, or t
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgacaaggtcgggtcccatccaggttcagttggctagtgcatcgtgggacagattaccactctacactatcagcagcctgcagcctagaagttntttagactaatttacttacgtgttacaactagttaattacgttaacgttaccccgttacggttcggtaaccggtttccgggaccgtaacgggggacccgtaaagggttcggaaacggttccgaaaccggtaaccgttaggtcgggtctacggtaccc

SEQ ID NO: 216227 - DNA, 595 bp, Homo sapiens
  misc_feature: GYAE6OF02HEFD7.1.34.D01.1.454.CMB.1.raw
  modified_base (433)..(433): a, c, t, g, unknown or other
  misc_feature (433)..(433): n is a, c, g, or t
tcagacgagtgcgtcacgaccggtgctcgatttagatcgtctgtgttgggtttgggggagtcagaccctgtcaggacacagcatggacatgaggtcccgcctcagctcctcgggcgtcctcgctgctcttggcgtcccctacggtaccgacgctcgttgacataccaattagtacccacgtcttcccactcctcccctgtctgcactctattggagacagagtcaccatcacttgccgggcgatcaggccatcacgcgacttctttacgtcctggttgcagcacgaaaccgacgggcgacgcccctcagatcgtagtctagtggtgcatccagattgcgaaggtcgggtcccactcgtacgggttacaggtcggcagttacgcacgttccgtggggacaagtacgtttacaccgtctcaactaatcacggacncgcctgcgacgccgtagaagttattttgactaattttacttactgtactaactagttaattacgtaaccgtacccttacggtggtacggttccggaccgaacgggggtacctaaagggtcggtaagtaccgtaaaccgtacggttggtacggtcgacgtacc

SEQ ID NO: 216228 - DNA, 501 bp, Homo sapiens
  misc_feature: GYAE6OF02FGFYH.1.34.D01.1.454.CMB.1.raw
  modified_base (265)..(265): a, c, t, g, unknown or other
  misc_feature (265)..(265): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctgttgcagcagaaaccngggcagcccctcagatcgtagtctatggtgcattccagattgcaaggtcgggtcccatccaggttcagtggcagtgcatctgggacagattacactctcactatcagtcaagcctgcagtccctagaactatttttcgactaaatttattaactgttacaacagttattaatagtacccctagtcgacgtcggaccgacgggaccaaggtggaagtcaaccgactggtgactgacc

SEQ ID NO: 216229 - DNA, 510 bp, Homo sapiens
  misc_feature: GYAE6OF02H6TEX.1.34.D01.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattgacccagtctccatcctcctgtctgcatctattgganacagagtcaccatcacttgccgggcagtcaggccatcagcgattctttagcctggttgcagcagaaaccagggcagcccctnacgatcgtagtctagtcggtgcatccagattgcaaggtcgggtcccatccaggttcagtggcagtgcatctgggacagacttacactctcacgtatcagctagcctgcagcctagaacgtattttgactaatttatacctgtacaactagttattactacgtacccgttagtcgtacgttcggccgtagggaccaaggttcgaagtacaaccgtaagtggacggtctgacc

SEQ ID NO: 216230 - DNA, 690 bp, Homo sapiens
  misc_feature: GYAE6OF02HGHLG.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattcttagcctggttgcagcaagaaaccagggcgacgcccctnagatcgtagtctagtggtgctatccagatttcgacgtaaaggggtcgggtaccccagtccgtagggtttcaggtcggactaggtcgacagttccgtaggggaacctaaggtaactttacaccgttctacctaacttaactcaaggccaacggtcccttaggacccaggtcccgttaagggtaaacgttacgtttttcggaactttaaagtttttactttaaccgtacgttaacctaaaccgttagtttaacgttttaaactaacccggtttaacccccgttaagggttacgggtaaccggttttcccgggaacccggtaaaccggggggtaacctaaagggggttacgggtaaacgttacccggtaaacccggtaacgtttacggggtacggtccggttagtaaccccg

SEQ ID NO: 216231 - DNA, 814 bp, Homo sapiens
  misc_feature: GYAE6OF02IZAAS.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgacgtcgacggaccatcgagacgttactttacgttacgccgttgggttcgacgtacgacgaaacgaaaccggacgggaccgaccgtcccctacgaacgtacgttacggtacgttacgttaggttcgggtacgtacctacgtaccgaaggttagttacggaacgggtaacgggggttcccgggtaccctacgtaccggtaggttaccgtagggtcggacgtaggtcgacgtacgttcggtacgggaactaaggttaactttaaccgtttacgtttaccaacgtttactacgaacgtacgtaaccgtcccgtacggaccgtaacgttaccgtaaggttaaacgttttacgttttacgaaaccttttaaattttttaaccgtaaccgttacgtaaacctaaaggtttaacgtttaaacgttttaaaccgtaaaccccggttaacccgtttaagggttaccgggttacccggtttaccgggaaacccggggtaaacggggtaaccgttaaacgggggttaaccggtaaaccgttaacccggtaaaacccggttacggttacgggttaccggtaccgttacccggacccttaacccg

SEQ ID NO: 216232 - DNA, 853 bp, Homo sapiens
  misc_feature: GYAE6OF02HV569.1.34.D01.1.454.CMB.1.raw
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttgccgggcgagtcacggccatcagcgtattctttagcctggttgcagcagaaaccagggcgacgcccctcagatcgtagtctatgggtncactccagtattaggcgtaaacggggttcggggtacccctaagttcccgtaaggggtttccgaagggttcgggacctaagggttcgacgtacgttacggtcgggggaaccgtaaggtaacgtttaacctaaccttccgttacctaacttaaacgttccaaacggtcccgtaaacggtcccctacgggtcccgtaacgtaccccgtttaagggtaaaacgtttacgtttttttacggtaacccttttaaaaagtttttttaacgttttaaacccgtttacgtttaaacccgtaaaccgtttaaacgtttttaaacgttttaaaaccgtttaaacccggttttaaccccccccggtttaaccggggttttaaccgggggttaacccggggtttttaccccggggggaaccccggttaaaaccgggggggggtaaaccccttaaaacggggggggttttacccgggtaaaacgggtttacccccggtaaaaaacccggggtttaaaccgtttaccgggggttttaccggggtaccgttaccgggtaaacccccg

SEQ ID NO: 216233 - DNA, 510 bp, Homo sapiens
  misc_feature: GYAE6OF02HI83Y.1.34.D01.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattgganacagagtcaccatcacttgccgggcgagtcaggccatcagcgattctttagcctggttncagcagaaaccngggcgagcccctgagatcgtagtctatggtncatccagattgacaaggtcgggcccatccaggttcagtggctagtcgcagtctgggacagattaccactctcactancagcagcctgacagctnaagtntttgactatttactctgttacaactagttattactaccgttacccgtaggtcgtacgttccggccggtaagggacgaagggtgaacgtacaaccggtatggnggtcngtaccg

SEQ ID NO: 216234 - DNA, 590 bp, Homo sapiens
  misc_feature: GYAE6OF02HSLEC.1.34.D01.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatccctccctgtctgcatctattggagacagatcaccatcacttggccgggcgagtcaggccatcagcattcttagcctggttncagacagaaaccngggccacgcccctnagtactcgtagtctagtggtcgcaactccaagtacgttggacgtaaggggtcgggtaccctataccgtaggttcaaggtcggacgtagtcggactagtcggtagggacagtacgttaacacgtctactacgtatacgacgcacgcctgcgtagccgtagtagtactttagtacttaattttaatactacgtaactaacgttaagttattaacgtaccgttacccgttaggtacggttaccggtcgggaccgaacggggacgtaaggtacggaacgtacgaaccggtacgttcggtagtctcgtaacc

SEQ ID NO: 216235 - DNA, 638 bp, Homo sapiens
  misc_feature: GYAE6OF02G4XB7.1.34.D01.1.454.CMB.1.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcgagaccctgtcaggacacagcatggacatgagggtccccgctcagctcctgggctcctgctgctctggctcccaggtaccagctgtgacatccaattgacccagtcctccatcctcccttgtctgcatctattgganacagagtcaccatcacttgccgggcagtcaggccatcagcgtattcttagcctggttgcagcagaaccnggcgacgcccctgacgntcgtagtctagtggtgcatccagtattgacgaaggggtcggtacccagtccgtaggttcgaggtcggactaggtcgctagtcgtagggactaggtacttaacctactcgtacctacgtttacactacgtacctaacgtccctagaccgtacgtacccgtaggtaagttacgttttcgaacgtttaatttacgttaccgttagttaccgaaacgttagttacttaaacgttaacccgttaacccgttacggtacgggttaccggttacgggtcccggtaaacggggtaccgtaacggggtacgtaacggttacccgaaccgggtacgttcgggtccggtaccgtacgtaacccg

SEQ ID NO: 216236 - DNA, 564 bp, Homo sapiens
  misc_feature: GYAE6OF02H1DI4.1.34.D01.1.454.CMB.1.raw
  modified_base (200)..(200): a, c, t, g, unknown or other
  misc_feature (200)..(200): n is a, c, g, or t
  modified_base (556)..(556): a, c, t, g, unknown or other
  misc_feature (556)..(556): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtcctccatccctccctgtctgcattctagttgganacagagtcaccatcacttggccgggcagtcaggccatcagcgattcttagctgttgcagacaagaaccgaggacgacgccctacagatcgtagtctagtggtgcagtccagtaattcggacgaaggggtcgggtcccaagtccgtaggttcaaggtggctagtgctagtcgaggggacaagtacttaccactctacaactatacagcagccctaggaccacgctaggtaaagtcttttagaactttaaatttatacttagtacaactatttaactataaccgtacccgtagtcggtacgttcggacggtaacgggaccgtaaggtacgagttaccaaccggtaagtcggtagtacncgtaaccg

SEQ ID NO: 216237 - DNA, 743 bp, Homo sapiens
  misc_feature: GYAE6OF02IHCGN.1.34.D01.1.454.CMB.1.raw
  modified_base (195)..(195): a, c, t, g, unknown or other
  misc_feature (195)..(195): n is a, c, g, or t
tcagacgagtgcgtcacgaccggtgctcgatttagatcgtctgtgttggggtttgggggagtcagaccctgtcaggacacagcatggacatgagggtccccgctcagctcctgggctcctgctgctctggctcccaggtaccagctgtgacatccaattgacccagtctccatcctcctgtctgcatctatggancagatcacatcacttgccgggcgagtcaggccatcagcgattcttagcctggttgcagcagaaaccgagggcgaacgccccctacaggtagtcgtagttcctagtggtcgactacgtccagtacttaggacggtaagggtcggggtacccctagttcccgtaacgggttcgaggtcgggctagggtgaccgtagtccggtaggggacctaagggttactttaacccgaccttaccttacctaaccttaagtaccgtaacggtaccgaaacccggcccgtttccggaaccgtacggttacccgttaagggtaaaccgtttagtttttacgaaccgttttaaaactttttacgtttaaccgtttacgttaaccgtaaccgttttaaaggtttaactttaacggtttaaaccgtaccccccggtttaaggttacgggtaccggttttacccggggacccgggttaacccggggaacgggtaaaccgggttacgggtaaacgttaccggtaaccgttaaccggtagggtaccggttaccgtacggtaccccg

SEQ ID NO: 216238 - DNA, 516 bp, Homo sapiens
  misc_feature: GYAE6OF02I31NJ.1.34.D01.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggcccatcagcgattcttagcctggttgcagcagaaaccngggcgagcccctnagatcgtagtctatggtgcatccagattggcaaggtcgggtcccatccaggttcagtggcagtgcatcgtgggacagtattacactctcactatcagcagtcctgcagcctgaagtntttgacttaatttatactgtacaagtattattactacgtacccgtagtgtaccggttcggccgtaagggaaccgtaagggtcgtaacgtccgaaaccgtcgtaggcggtcctgtaccc

SEQ ID NO: 216239 - DNA, 503 bp, Homo sapiens
  misc_feature: GYAE6OF02HHWW5.1.34.D01.1.454.CMB.1.raw
  modified_base (281)..(281): a, c, t, g, unknown or other
  misc_feature (281)..(281): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgacaaggtgggtcccatcgaggttcagtggcagtgcatctagggacagattacactctcactancagcagcctgcagcctgaagtnttttgacttaatttattactgttacaatagttaattatacgtaccctagtcggtacgttcggcctaggggaccaagggtcgaagtccgaacggtactggcggctgacc

SEQ ID NO: 216240 - DNA, 534 bp, Homo sapiens
  misc_feature: GYAE6OF02G8KGQ.1.34.D01.1.454.CMB.1.raw
  modified_base (412)..(412): a, c, t, g, unknown or other
  misc_feature (412)..(412): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcgaaggtcgggtcccagtccaggttcagtggacagtgcagtctagggacagtaattacactctacgactagtacagccacgcctggcacgtcctagtaacgtnttttgactaatttattactgtacaactagttattatacgtaccctagtcggacgttacggccgtaagggtaccgaagggttacggaagttaccgaacggtacgtacggacggtcaggtaccc

SEQ ID NO: 216241 - DNA, 523 bp, Homo sapiens
  misc_feature: GYAE6OF02I977D.1.34.D01.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagccttggttgcagcagaaaccagggcgacgcccctnagatcgtagtctagtggtgcatccagtattgcgtaaggtcgggtcccagtccaggttcagtggcgagtcgactagtcgtagggacagtaacttacactctacactatcagcacgctgcacgcctagagtatttgattaatttattactntacaatattaattataacgtccctagtcggacgttcggcgtaacggacgtacggtaggaagtaccgaaccggtacgtggtacggctgaaccg

SEQ ID NO: 216242 - DNA, 625 bp, Homo sapiens
  misc_feature: GYAE6OF02HI9PS.1.34.D01.1.454.CMB.1.raw
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatcctccctgtctgcatctatggagacagagtcacatcacttcggccgggcagtcaggccagtcaagcgtatttctttacgccttggttcncacgacaacgaaaccgagggaccgacgcccctgagtactacgtacgtctagtggtnactatcctagtattcgacgtaaggtcggtacccacgttccgaggtttcaaggtcggactaacggtcgacctacgttcggtacgggaactaacggtactttaaccgaccttacctacgaacttacgtacgacgtacgacgtccgtagtacctacgtaccgtaaggtaactttacgtttacgtaacttaagttttactacgtacgtaactaagttacgttaacttactaaccgttacccgtagtacggtacgttccggacggacgggtaacgtaggtacgtaacgtacgaacgtagtgtacgtctcgaccg

SEQ ID NO: 216243 - DNA, 540 bp, Homo sapiens
  misc_feature: GYAE6OF02JG5G8.1.34.D01.1.454.CMB.1.raw
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctcagactcgtagtctagtggtgcatccagattagcgtaagggtcgggtcccatccgaggttcaggtggcagtgactagtcgtgggacagacttacactctacaactatcacgcgacnccgtagcgacgtcctagtaacgttatttgacttaattttactactgtactaacgtagttattaactaaccgtaccctaggtcgtacgttcggacgaacgggtactaaggtacggaacgtacgaacggtactggtcgctgtacc

SEQ ID NO: 216244 - DNA, 529 bp, Homo sapiens
  misc_feature: GYAE6OF02HKG13.1.34.D01.1.454.CMB.1.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcaagaaaccgngggcgacgccccctnagatcgtagtctagtggtncatccagtattgacgtaagggtcgggtacccagtccgaggttcagtggcagtgctagtcgtgggacagattacactctcactatacagcacgcctgcacgcgtagaatatttgacttaatttactactgtacaatagttaatactacgtacccgtacgtcggtacgttacggcggaacgggtacgtaaggtcggaacgtacgaacgtacgtggtacggtcctgacc

SEQ ID NO: 216245 - DNA, 542 bp, Homo sapiens
  misc_feature: GYAE6OF02HMX51.1.34.D01.1.454.CMB.1.raw
  modified_base (230)..(230): a, c, t, g, unknown or other
  misc_feature (230)..(230): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaaccagggcgagcccctcagatcgtagtctatggtgcatccagattgcaaggtcggggtcccatccaggttcaggtggcagtgcatctggacagattacactctcactatcagcagcctgcacgcctgaagtatttcgactaatttattactgtacaactagttattacgtaacgtaccccttaggtcggtaccgtttcgggaccgaacggggtacctaaagggtcggaagtaccgaacgtaccgttggtcggactcggaccaccgtattcgttacgttccttacacgttcccttaccccgtacc

SEQ ID NO: 216246 - DNA, 495 bp, Homo sapiens
  misc_feature: GYAE6OF02G4VXI.1.34.D01.1.454.CMB.1.raw
  modified_base (486)..(486): a, c, t, g, unknown or other
  misc_feature (486)..(486): n is a, c, g, or t
tcagacgagtgcgtcacgaccggtgctcgatttagatcgtctgtgttgggtttgggggagtcagaccctgtcaggaaacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcgaaggtggggtcccatccaggttcaggtggcagtgcatctggacagattacactctcactatcagcagcctgcacgcctgaagtatttgacttaatttattactgtactaactagttattatacgtaccctagtcgacgttcggcgacgggacctaaggtgaagtcaacgactgnggctgctac

SEQ ID NO: 216247 - DNA, 520 bp, Homo sapiens
  misc_feature: GYAE6OF02I55N8.1.34.D01.1.454.CMB.1.raw
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (515)..(515): a, c, t, g, unknown or other
  misc_feature (515)..(515): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctatggtgcatccagattgcaaggtcgggtacccagtccgtaggttcaaggtggcagtgcatcgtgggacagatactactctcactatcancancctgcagcctagaactatttgacttaatttattactgtacaatataattatacgtaccctagtacggtacggttcggacggtagggacgtaagggtacggaacgtacgaaccggtaacgtggtagtacgngtacc

SEQ ID NO: 216248 - DNA, 599 bp, Homo sapiens
  misc_feature: GYAE6OF02HPNU6.1.34.D01.1.454.CMB.1.raw
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggtgcagcaagaaaccgngggccgacgcccctcagatcgtagtctagnggtgcatccaaggtacttggcgaaggggtcggggcccctagtcccgaggttccaggtggacaggtncatcgtgggactagtatacactctacactatcacgcagcctagcagccttaggaattatttnacttaaatttacttactgtactaaactagttactttaactacgttaccccttaaggtacggtacgttcggaccggaacggggtaaccgtaagggtaggtaaccgtaacgaacccgtaacgttaggtcggtaccgtacgtacccaaccgttagtccgtttacggttcccttaacgtacctttccccggtaccctacccg

SEQ ID NO: 216249 - DNA, 497 bp, Homo sapiens
  misc_feature: GYAE6OF02F0ESX.1.34.D01.1.454.CMB.1.raw
  modified_base (377)..(377): a, c, t, g, unknown or other
  misc_feature (377)..(377): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcaggtggcagtgcatcgtgggacagattacactctacactatcancagccctgccagccctagaagtattttgacttaatttattactgtacaatagtattatacgtaccctagtcgacgtcggcgagggaccaaggtgaacgtacgaaccgagtgtggctgacc

SEQ ID NO: 216250 - DNA, 554 bp, Homo sapiens
  misc_feature: GYAE6OF02H8M25.1.34.D01.1.454.CMB.1.raw
  modified_base (259)..(259): a, c, t, g, unknown or other
  misc_feature (259)..(259): n is a, c, g, or t
  modified_base (323)..(323): a, c, t, g, unknown or other
  misc_feature (323)..(323): n is a, c, g, or t
tcagacgagtgcgtcacgaccggtgctcgatttagatcgtctgtgttgggtttgggcatggacatgagggtccccgctcagctcctgggggctcctgctgctctggctcccaggtaccagctgtgacatccaattgacccagtctccatcctccctgtctgcatctattggagacagagtcaccatcacttggccgggcgagtcaggccatcagcgtattctttagcctggttgcagcagaaaccagggcgagcccctnagatcgtagtctatggtgcatccagattgacgaaggtcggggtcccatccaggttcaggtggcnggtgctatcgtgggacagacttaacactctcacttagcagcacgcctgccacgcctagaagttatttgacttaaagttttattactagtacaactagttattaacgtacgttacccttacggttggtaccggttcggaccggaacggggtaccgaagggtacggaacgtaccaaccgacgtggtcggactgaccgaccagttcgtacttcctactctttcccgtccgtacc

SEQ ID NO: 216251 - DNA, 697 bp, Homo sapiens
  misc_feature: GYAE6OF02JITHA.1.34.D01.1.454.CMB.1.raw
  modified_base (228)..(228): a, c, t, g, unknown or other
  misc_feature (228)..(228): n is a, c, g, or t
  modified_base (294)..(294): a, c, t, g, unknown or other
  misc_feature (294)..(294): n is a, c, g, or t
tcagacgagtgcgtcacgaccggtgctcgatttagatcgtctgtgttggggtttgggggagtcgagacccgtgtcaggacacagcatggacatgagggtcccgctccagctcctcgggctcctgctgctctggctcccaggtaccagcctgtgacatccaattgacccagtcctccatcctccctgtctcgcatctattggagacagactcaccatcacttgccgggngagtcaggccatcagtcgtattccttagcctggttcgcagcacgaaccagggacgacgccccgtanagactcgtagtctagtcggtacgcgtactccgaggtacttcgacgtaacgggttcgggtccctacgttacccgaaggttccgaaggttacggactaagtactacgttcgtacgggaactacggtacgtttaaccgaccgttacttaccgaaacttaacgtaccgacggtacctacgtcccgttacgtaccgaacgttcccgtaaggtaaccgttaagtttttaccggaactttaaacgttttaacgtttaccgttacggttaacctaaaaccgttagttaacgtttaacgttacccgtaacccggttacgtacgggtacccgttaccgggaccgtaaccggggaacctagggtacggtaacgtacccgtaaccggtaactcggtcgtacgtccgaccctaccg

SEQ ID NO: 216252 - DNA, 379 bp, Homo sapiens
  misc_feature: GYAE6OF02GPYHH.1.34.D01.1.454.CMB.1.raw
  modified_base (371)..(371): a, c, t, g, unknown or other
  misc_feature (371)..(371): n is a, c, g, or t
  modified_base (376)..(379): a, c, t, g, unknown or other
  misc_feature (376)..(379): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtgacgttcgccaggggaccaaggtggaagtcaacgaactgtgctgcacatctgtcttcatcttcccgcctctcacgcactcgtctgagcgggctggcaaggcnatagnnnn

SEQ ID NO: 216253 - DNA, 403 bp, Homo sapiens
  misc_feature: GYAE6OF02I2EBD.1.34.D01.1.454.CMB.1.raw
  modified_base (388)..(403): a, c, t, g, unknown or other
  misc_feature (388)..(403): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttatactgtcaacagtattatacgtacccctagtggacgttcggccaggggaccaaggtggaagtcaacgaactgtggctcgcaccatctgtcttcatcttcccgcatctagaacgcactcgtctgcgcgggctgggcaaggcgacatagnnnnnnnnnnnnnnnn

SEQ ID NO: 216254 - DNA, 498 bp, Homo sapiens
  misc_feature: GYAE6OF02I788V.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtgggtcccatccaggttcagtggcagtgcatctgggacagattacactctacactatcacgcagcctgcagcctgaagtatttgactaatttattactgtacaactagttattactacgtaccctagtcgtacgttcggcgagggaccaggtagaagttcgaaccgacttggcggtctgaccg

SEQ ID NO: 216255 - DNA, 536 bp, Homo sapiens
  misc_feature: GYAE6OF02HO4RQ.1.34.D01.1.454.CMB.1.raw
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
  modified_base (532)..(532): a, c, t, g, unknown or other
  misc_feature (532)..(532): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagcctggttncagcagaaaccgagggcgacgcccctnagatcgtagtctagtggtgcatccagtattggacgaaggggtcgggtcccagtccgaggttcaggtggcgtagtcgactagtcgtgggaactagtacttacactctacacttactcagtcacgcctgcacgctagagtattttgacttaatttattactgtacaattagttattatacgtaccctagtcgtcgttacggcggacgggacgtaaggacgtaacgtacgaaccgtagtacggcggtacngacc

SEQ ID NO: 216256 - DNA, 390 bp, Homo sapiens
  misc_feature: GYAE6OF02HJSYQ.1.34.D01.1.454.CMB.1.raw
  modified_base (252)..(252): a, c, t, g, unknown or other
  misc_feature (252)..(252): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (382)..(390): a, c, t, g, unknown or other
  misc_feature (382)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacngtattatagtacccctacgtggacgttcggcaggggaccaaggtggaagtcaaccgaactgtggctgcacatctgtctnactctccgccatctgaacncactcgtctgagcggctggacaggcnagtagnnnnnnnnn

SEQ ID NO: 216257 - DNA, 504 bp, Homo sapiens
  misc_feature: GYAE6OF02JIK4I.1.34.D01.1.454.CMB.1.raw
  modified_base (459)..(459): a, c, t, g, unknown or other
  misc_feature (459)..(459): n is a, c, g, or t
  modified_base (464)..(465): a, c, t, g, unknown or other
  misc_feature (464)..(465): n is a, c, g, or t
  modified_base (468)..(469): a, c, t, g, unknown or other
  misc_feature (468)..(469): n is a, c, g, or t
  modified_base (471)..(504): a, c, t, g, unknown or other
  misc_feature (471)..(504): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattaccactctcactatcagcagcctgcagcctgaagtattttgctaatttattactgtccaaactagttaattatacgtaccccctagtcgggtaacgttcggaccgagggggaccctaaagggttggaaaagttccgaaaccgaacttggtacggcctggaccaccgtatcctcggtcctttacattcctttccccgctaattctacgaacgcctacgttcctactcggaacgcgggtactggaccgaagggtcgaccgtataacggnatcgnnctnnannnnnnnnnnnnnnnnnnnnnnnnnnnnnnnnnn

SEQ ID NO: 216258 - DNA, 585 bp, Homo sapiens
  misc_feature: GYAE6OF02JRDA8.1.34.D01.1.454.CMB.1.raw
  modified_base (128)..(128): a, c, t, g, unknown or other
  misc_feature (128)..(128): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (337)..(337): a, c, t, g, unknown or other
  misc_feature (337)..(337): n is a, c, g, or t
tcagacgagtgcgtcacgaccggtgctcgatttagatcgtctgtgttggggtttgggggcatggacatgacgggtccccgctcagctcctggggctcctgctgctctggcctccaggtaccagctgtnacatccaattgacccagtctccatccgtccctgtctgcatcgtattggagacagagtcaccatcacgttgccgggcgagtcaggccatcagcgtattcttagccttggttgcagcagaaccngggcacgcccctnagatcgtagtctatggtnctatccagtattcgcgaaggtcgggtcccagtcccgaggttcgaggtggctaggtncagtcgtaggactaggtacttacactctacactactcacgtcacgtcctagaccgaggtcctagaagttactttacgacttaaacgtttactaacgtcgtactaaacgtagttacttacgtacgttacccctaggtacgtaccgttcggaccgtacgggtaccaggtacggactaccggactaaggtcgaacggtctcgaaccacgtaacttcgtacgttaccttccgtacgtttccctacccccgtc

SEQ ID NO: 216259 - DNA, 660 bp, Homo sapiens
  misc_feature: GYAE6OF02I7PLJ.1.34.D01.1.454.CMB.1.raw
  modified_base (102)..(102): a, c, t, g, unknown or other
  misc_feature (102)..(102): n is a, c, g, or t
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
tcagacgagtgcgtcacgaccggtgctcgatttagatcgtctgtgttgggtttgggggagtcagaccctgtcaggacacagcatggacatgagggtccccgntcagctcctggggctcctgctgctctggcctcccaggtaccagctgtgacatccaattgacccagtcctccatccctccctgtctgcatctattgganacagatcaccatcacttggccgggnagtccaggccatcgagcgtattctttacgccttggttgcagcagaaaccngggcacgcccctanagatcgtagtctagtggtnacatccagtattgacgaacgggtcgggtcccatccgtaggttcaggtcggctagtgctagtcgtgggaactagtacttaccacgtcctacacgttactcgaagccgtaacgtccgtagaccgtacgtccgtaggtaaacgtttcgttttacggaacttttaaagttttaccttaacgttacgtaaccgtaaacgttaagtttaacttaaccgttaaccgttaccccgttaacgggttcggttaaccggtttccgggaacccggtaagggggtaacccgttaacggggtaacggtaaaccgtttaacccgaaaccggttaaccgttgggttaccggtaccgttagtaacccgg

SEQ ID NO: 216260 - DNA, 525 bp, Homo sapiens
  misc_feature: GYAE6OF02INJ8S.1.34.D01.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
tcagacgagtgcgtcacgaccggtgctcgatttagatcgtctgtgttggggtttggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtncatccagattgcgaagggtcgggtcccatccaggttcagtgcagtgcatcgtgggacagattacactctcactancagcagcctgcagcctagtaagtatttcgacttaatttattactacgtactaacgtagttaattactaacgttaccccgtaggttcggtaccgttcggaccgacggggtaaccaagggtacggaacgtccaaccggactggtggactgccacatcttcgtctcacttcctcccac

SEQ ID NO: 216261 - DNA, 587 bp, Homo sapiens
  misc_feature: GYAE6OF02G58LP.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatccgtagtctagtggtgcatccagtattggactaagggtcgggtccccatccgaggttcaggtggcagtgacatcgtgggactaggtattaccacttctactactatcagcacgcctgcctacgcctagaagttattttgacttaattttacttacttgtacaaacttagttaacttaagttacgtaaccccgttaggttaccggtaccggttaccgggaccggtaacgggggtaacccgtaaaggggtacggtaaacgttaccggaaaccgtaacggttcgggtacggtcctaggtaaccccg

SEQ ID NO: 216262 - DNA, 689 bp, Homo sapiens
  misc_feature: GYAE6OF02I32S7.1.34.D01.1.454.CMB.1.raw
  modified_base (103)..(103): a, c, t, g, unknown or other
  misc_feature (103)..(103): n is a, c, g, or t
  modified_base (229)..(229): a, c, t, g, unknown or other
  misc_feature (229)..(229): n is a, c, g, or t
tcagacgagtgcgtcacgaccggtgctcgatttagatcgtctgtgttggggtttgggggagtcagaccctgtcaggacacagcatggacatgagggtccccgntcagctcctggggctcctgctgctctggctcccaggtaccagctgtgacatccaattcgacccagttctccatcccttccctgtctgcattctattggagacagagtcaccatcacttcgccgggntagtcaggccatcagcgattctttagccttggttgcagcagaaaccagggccgaagcccctcagacgtaccgtagtctagtaggtcgcactccagtatttcggacgtaaacggggtcggggtacccctaatccccggtaagggtttccgaaggttcggggacctaagttcggtacgaacgttccgtaggggaactaggaactttaaccaaccgtttcctaacaaccttaacgtaccgaggaccgtacgcccgttaggccaacggtcccgtaagaagtttaacgttttcgacgttaaatttttacgtaacgttaggttacctaaagtagtttaaatttacgtaacgtaacccctttagggtacggttacggttaccgggacggtaaccggggtaacgaaacgggttacgggtaaacgttaccggaaccgtaagttacgggtacgggtacgtcggtaacccg

SEQ ID NO: 216263 - DNA, 570 bp, Homo sapiens
  misc_feature: GYAE6OF02JY6CY.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcagtcaggccatcagcgatttctttagcctggttgcagcagaaaccngggccgagccccncagactcgtaagtcctagtggtacgcatccagtatgcgtaagggtcgggtacccatccgtaggttcagtcggctagtgactagtcgtgggacagtataccgattcactactatcaagcagcctgcagtcctagaattcttttagacttaatttacgtatactaacgaacttaagttacttaaacgtacgttaaccccttagggtacgtccggtttacggaccggtaacggaccgtaagggtaggtaaccgtacgaaaccggtacgttacggtcggtaccgtacgtacccg

SEQ ID NO: 216264 - DNA, 386 bp, Homo sapiens
  misc_feature: GYAE6OF02GCEU6.1.34.D01.1.454.CMB.1.raw
  modified_base (383)..(386): a, c, t, g, unknown or other
  misc_feature (383)..(386): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgaactgtggctgcaccatctgtcttcatctcccgccatctcgaacgcactcgtctgagcggctggcaaggcgcatgnnnn

SEQ ID NO: 216265 - DNA, 554 bp, Homo sapiens
  misc_feature: GYAE6OF02GKGUY.1.34.D01.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (434)..(434): a, c, t, g, unknown or other
  misc_feature (434)..(434): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagatcaccatcacttgccgggnagtcaggccatcagcgattcttagcctggttgcagcagaaaccngggcgacgccccctnagatcgtagtctagtggtgcatccagtattgcaaggtcgggtcccatccgaggttcagtcggcagtcgctatcgtgggactagacttacgactctacactatcacgcacgcctgacacgtcctagaacgtattttagacttaatttactacgtntacctaatagtaacttaacgtacgtaccccttaggtacggtaccgttaccgggacggaacgggtaaccgaagggtacggtaacgtaccgaaccggtaccgttggtacgtcgtagtacccg

SEQ ID NO: 216266 - DNA, 604 bp, Homo sapiens
  misc_feature: GYAE6OF02FRZ4C.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcacatcacttggccgggcagtcaggccatcagcgtattctttagccttggttcgctagcaagaaaccaggggcgacgcccctcagatcgtagtctagtggtgcatccagtattgcgaaggtcgggtacccatccgagttcgaggtggacagtgctagtcgtgggaactaggtacttaacacttacctactaaccttatcaacgcacgccttgcacgacctagtaagtacttttagacttaatttaactttactacgttaacaaacttacgtttaaattaaacttaacggttaaccccctaaggttaccggtaaccggttccgggtaaccgaaggggtaacccgtaaagggttacggtaaacgtaaccgtaaccgtaagttaggtacggtacgtataacccg

SEQ ID NO: 216267 - DNA, 409 bp, Homo sapiens
  misc_feature: GYAE6OF02HJLMY.1.34.D01.1.454.CMB.1.raw
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
  modified_base (398)..(409): a, c, t, g, unknown or other
  misc_feature (398)..(409): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtggggtcccatccaggttcagtggcagtgcatcgtgggacagattacactctcactatcagcagcctgcagcctagaagtattttgactaatttattactgtacaactagtattatacgtacccctagtggacgttcggccaggggaccaaggtgaagtcaacgactggnggctgcacatctgtcttcacttccttccgcatcagaccgctactcgtcnggacgtcgggctggacaggcgcaagtacgnnnnnnnnnnnn

SEQ ID NO: 216268 - DNA, 538 bp, Homo sapiens
  misc_feature: GYAE6OF02HIYTQ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttggccgggcagtcaggccatcagcgattcttagcctggttgcagcaagaaaccagggcgacgcccctcagactcgtagtctagtggtgcatccagattgacaagggtcgggtcccatccgaggttcaggtggcagtgctatcgtgggacaggattacactctcactatcagcagcctagcagcctagaagtatttcgactaattttactacgtagtacaatagttaattacgtacgtaccccttaggtcgtacgttcggacgtacgggaacgtaacgggtaggtaacgtaccgaaccggtaaccgtaggtcggacgtagtacccg

SEQ ID NO: 216269 - DNA, 636 bp, Homo sapiens
  misc_feature: GYAE6OF02JWJ01.1.34.D01.1.454.CMB.1.raw
  modified_base (126)..(126): a, c, t, g, unknown or other
  misc_feature (126)..(126): n is a, c, g, or t
  modified_base (196)..(196): a, c, t, g, unknown or other
  misc_feature (196)..(196): n is a, c, g, or t
  modified_base (275)..(275): a, c, t, g, unknown or other
  misc_feature (275)..(275): n is a, c, g, or t
  modified_base (349)..(349): a, c, t, g, unknown or other
  misc_feature (349)..(349): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctntggctcccaggtaccagctgtgacatccaattgacccagtctccatcctcctgtctgcatctagttgganacagatcaccatcacttgccgggcagtcaggccatcagcgattcttagcctgttgctagcagaacaggcgagtcccgtnagatcgtagtctatgtgtacatccagattgctaaggtcgggtaccagtcgaggttcacgtgcgtagtgcatcgnggtactggattacgactcttaccacgttactactacgcgtaacggtcccttggacccttagacccgtttagaacgttacgttttaacggttcctaaaatttttacgttaacttacgttacctaaacgttactttaaatttaacgttaacgttaaacccctttacgggttacggttaaccggttttaacccgggccggttaaaccgggaacccggtaaagggtaaccggttaggtaaccggttaaaccggtaaaacgttccggttaacggttccgtttaacgacccgg

SEQ ID NO: 216270 - DNA, 550 bp, Homo sapiens
  misc_feature: GYAE6OF02IDW76.1.34.D01.1.454.CMB.1.raw
  modified_base (275)..(275): a, c, t, g, unknown or other
  misc_feature (275)..(275): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccactcctccctgtctgcatctattggagacagagtcaccatccacttcggccgggcgacgtcaggccatcagcgattctttagcctggttgcagcagaaacccnggggcgacgcccctacagactcgtagtctagtggtgcactaccagtattgacgaagggtcggggtcccattcccgaggttcaggtcggcagtcgctatccggtgggactagtacttactactctaccactatcagcacgcctgcagcctagaagttntttnactatttntactntcaactagttattactacgtacccttaggtcgtacgttaccgggcggtaacgggacgtaagggtgaaacgtccgaaaccgtacgtggtacggtctagaccg

SEQ ID NO: 216271 - DNA, 492 bp, Homo sapiens
  misc_feature: GYAE6OF02GMJFK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcacgcccctcagatcgtagtctatggtgcatccagattgcaaggtgggtcccatccaggttcagtggcagtgggtctgggacagagttcactctcaccatcagcagcctgcagtcagaagtctttgctagtttattactatcagcagtataatgtactgggccttcggggttgccgtaggggaccaaggcgtaggagactacgaaacgtacgtgtggctacg

SEQ ID NO: 216272 - DNA, 572 bp, Homo sapiens
  misc_feature: GYAE6OF02FTIU5.1.34.D01.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattctttagcctggttgcagcagaaaccgngggcgacgcccctcagatcgtagtctatggtgcatccagtattcgcgtaagggtcgggtacccagtcccgaggtttcaggttcgggcaggttcgctagttcgtaggggaacaggtacttaccaccttctactactatcgacgcgaacgcctgccagtcctacgtaagtattttacgacttaatttacttactacgtactaactagttaatacgttacgtaccccttagtcggtacgtccggtaccgtagggaccctaagggtacgtaacgtaccgaacgtacgttacgtacggtctacgtaccg

SEQ ID NO: 216273 - DNA, 543 bp, Homo sapiens
  misc_feature: GYAE6OF02HCEHC.1.34.D01.1.454.CMB.1.raw
  modified_base (261)..(261): a, c, t, g, unknown or other
  misc_feature (261)..(261): n is a, c, g, or t
tcagacgagtgcgtcacgaccggtgctcgatttagatcgtctgtggttgggtttgggcatggacatggacgggtccccgctacgagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgacgcccctnagatcgtagtctagtggtgcatccagattgacgaagggtcgggtccagtcctaggttcaggtggcagtgctagtcgtacgggacagtacttacactctcactatcagcacgctgcacgctagaagtatttacgacttaatttacttactgtacaactattactactactacccgtagtacggtacgttccggaccgtaagggacgtaggtcgaacgtacgaccgtacgtggtacggtctacgctactactcgtcttccttacgaccttccgtaccctacccg

SEQ ID NO: 216274 - DNA, 590 bp, Homo sapiens
  misc_feature: GYAE6OF02JKZ6P.1.34.D01.1.454.CMB.1.raw
  modified_base (196)..(196): a, c, t, g, unknown or other
  misc_feature (196)..(196): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattgganacagagtcaccatcacttgccgggcagtcaggccatcagcattcttagcctggttgcagcagaaaccagggcgacgcccctcagactcgtagtctagtggtncatccagattgcaggtcgggtcccagtccaggttcagtcggacagtgcagtcgtgggacagatttacgactctcactatcagcagtcctgccagtcccgtagtaagttacttttggacttaaacgtttttattaccgtttgttaacctaattaacgtttaatttaacgtacggttaaccccttacgttacggtaacgttttcccgggaacggtaccgggggtaaccgtaaggggttaacgggtaacgtaccgaaaccgggttaaccttagggtccggtaccgttagaccccg

SEQ ID NO: 216275 - DNA, 623 bp, Homo sapiens
  misc_feature: GYAE6OF02IRGL3.1.34.D01.1.454.CMB.1.raw
  modified_base (128)..(128): a, c, t, g, unknown or other
  misc_feature (128)..(128): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
  modified_base (484)..(484): a, c, t, g, unknown or other
  misc_feature (484)..(484): n is a, c, g, or t
tcagacgagtgcgtcacgaccggtgctcgatttagatcgtctgtgttgggtttgggggtaggtcgagaccctgtcaggacacagcatggacatgagggtcccgctcagctcctgggctcctgctgctntggctccaggtaccagctgtgacatccaattgacccagtctccatcctcctgtctgcatctattggagacagagtcaccntcacttgccgggnagtcaggcatcagcgtattcttagcctaggttcgcagcaagaaaccgngggacgacgcccctgagactcgtagtctagtggtgacactccgagtattgacgtaagggtcgggtacccagtcccgtaggtttacaggtcggaccgtaggtcgacttagtcgtagggaactaggtaacttaccaacgttcacgtaacgttatccgaagtccgaagtccctagacacgtaccagtaagttattttcgaactttaaatttactttancgttaacaacgttagttaatttaacacgttaaccccttagggacgttaacggttccggaaccgtaacgggggaacctaaaggggttcgtaaacggtaccgtaaaccggtaaccggttggtacggtaccgtacgtaaccg

SEQ ID NO: 216276 - DNA, 641 bp, Homo sapiens
  misc_feature: GYAE6OF02JK1Z3.1.34.D01.1.454.CMB.1.raw
  modified_base (277)..(277): a, c, t, g, unknown or other
  misc_feature (277)..(277): n is a, c, g, or t
tcagacgagtgcgtcacgaccggtgctcgatttagatcgtctgtgttgggtttgggggagtcagacctgtcaggacacagcatggacatgagggtcccgctcagctcctggggctcctgctgctctggctcccaggtaccagctgtgacatccaattgacccagtctcatcctcctgtctgcatctattggagacagagtcaccatcacttgccggcagtcaggccatcagcgtattcttagcctggttcgcagcagaaccgagggcgacgcccctnacgacgtcgtagtctattggtcgcaatccgaagtacttcggacgaacggggtcgggtacccacgttccgtagggtttaccaggtacggccgtaggtcgacctaagtcggtacggggaactaggtaacttaccgtaactcctactaactattcgaagtcgaacgccgttacgctacgcccgttaagaacgttatttagaacttaaattttacttacgtagtacctaaagttagttaaactttataacccggttaacctacgggttcggtaaccggttccgggtaacggaacggggtaaccgaaacgggttacggttaaacggacccgttaaacggaaccggttaggtcgggtacctagggaaccc

SEQ ID NO: 216277 - DNA, 591 bp, Homo sapiens
  misc_feature: GYAE6OF02I1RO0.1.34.D01.1.454.CMB.1.raw
  modified_base (286)..(286): a, c, t, g, unknown or other
  misc_feature (286)..(286): n is a, c, g, or t
  modified_base (398)..(398): a, c, t, g, unknown or other
  misc_feature (398)..(398): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgatccagtctccatcctccctgtctgcatctattggagacagagtcaccatcacttgccgggcgagtcaggccatcagcgtatttcttagccttggttgcagcaagaaaccgagggcgacgcccctnagatcggtagtctagtggtgcatccagtattgacgtaagggtcggggtacccagtccgaggtttcaggtggcagtgactagtcgtagggacagtaacttacactctcaactntcagcacgcctagccagcctagtaagttctttagacttaattttactactcgtaacaacttaagttaactttaacgtaaccgttacccgtacggtacgggttaccggttccgggaaccggtaaacgggggaaccctaaggggtacggtaaccgtaccgtaaacccggtaacgttcgggttacggcttaaccgg

SEQ ID NO: 216278 - DNA, 547 bp, Homo sapiens
  misc_feature: GYAE6OF02FQNFN.1.34.D01.1.454.CMB.1.raw
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtncatccagattgacgaagggtggggtcccatccgaggttcagtggcagtgcatcgtgggacagattacnctctcactancagcacgcctgcagcctagaagtattttgacttaatttattacgtgtactaacagttaattactaacgttacccctagtcgggaccgttccgggaccgtaaggggaacccgtaaggggttacgaacggttaccgaaaccggtaacgttgggtacgggtcgttaggacccg

SEQ ID NO: 216279 - DNA, 576 bp, Homo sapiens
  misc_feature: GYAE6OF02HT7RI.1.34.D01.1.454.CMB.1.raw
  modified_base (283)..(283): a, c, t, g, unknown or other
  misc_feature (283)..(283): n is a, c, g, or t
  modified_base (423)..(423): a, c, t, g, unknown or other
  misc_feature (423)..(423): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggcgacgcccctanagactcgtagtctatggtgctatccagtattggacgtaagggtcgggtcccaagtccgaggtttcaggtggcgtagtgctagtcgtgggactagtattacactctcactatcacgcagtcctgacagcctagaaacgttnttttggacttaattttattactagttactaagtagtttaacttattaaccgttacccgtaagttcggacggttccggacggtaacggggaaccctaagggtacgggtaacgtaccgaaacccggtaccgttagggtacggtccgtagtacccg

SEQ ID NO: 216280 - DNA, 578 bp, Homo sapiens
  misc_feature: GYAE6OF02JPB9T.1.34.D01.1.454.CMB.1.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccggcgagtcaggccatcagcgattcttagcctggttgcagcagaaaccngggcgacgcccctanagatcgtagtctagtggtcncatccagattgacgaaggtcgggtcccagtcccgaggttaccaggttggcagtcgactacgtcgtagggacaggtatttaccacttctacagtctacagctacgcctagcctagcctagaagttactttacggacttaatttacttacgtgttactaactagttattactaccgttacccgtagttggtaccgttcggtacccggtaaggggtacccgtaaagggttacggtaaccgttaccggaaccgtacgttcgggtacggtccgtagtaacccg

SEQ ID NO: 216281 - DNA, 507 bp, Homo sapiens
  misc_feature: GYAE6OF02GH4IF.1.34.D01.1.454.CMB.1.raw
  modified_base (268)..(268): a, c, t, g, unknown or other
  misc_feature (268)..(268): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccngggcacgcccctcagatcgtagtctatggtgcatccagtattgcaaggtcgggtcccatccaggttcaggtggcagtncatcgtgggacagattacnctctcactatcagcacgcctgcagcctagaagtntttgactaatttacttctgtactaactagttacttatacgtacccttagtcggtacgttcggcgtagggacctaaggtcggactaccgaacgtacgtggtgctagacc

SEQ ID NO: 216282 - DNA, 599 bp, Homo sapiens
  misc_feature: GYAE6OF02G2O1O.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcacgcccctnagatcgtagtctagtggtgcatcagtattgacgtaagggtcgggtcccagtccgtaggtttccgaggttcgggcaggttcgactacgttcggtaggggaacaggtaacttaccgactctacctactagtaccagacacgcctgcagcctagtaagtactttgacttaattttacttactagtacaacgttagttaacttacgtaaccgttaccccgttaggtcggtaaccggttccgggaccggtaacggggtaacccgtaaggggtaacggtaaccggtaccgaacccggtaacgttcgggtacggccttacgacccg

SEQ ID NO: 216283 - DNA, 596 bp, Homo sapiens
  misc_feature: GYAE6OF02HKX0I.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttgccgggcgagtcaggccatcagcgattcttagcctggttgcagcaagaaaccgagggcgacgcccctcagatcgtagtctatggtgcatccagtattgcaagggtcggtcccagtccaggttcagtggcagtgcatcgtagggacagtattaccactctacactatcagcacgcctggcagccgtagaagttagttttacgactttaaacttttagttaacctacgttactaaacttagtttaactttaacttaaccggttaaccccgttaacggttcgggttaaccggtttccgggacccggtaacgggggtaaccgtaaaggggcgggtaaacgttaccgaaaccggtaacgttcgggtacggtccgtacggtacccg

SEQ ID NO: 216284 - DNA, 535 bp, Homo sapiens
  misc_feature: GYAE6OF02HVZSV.1.34.D01.1.454.CMB.1.raw
  modified_base (501)..(501): a, c, t, g, unknown or other
  misc_feature (501)..(501): n is a, c, g, or t
  modified_base (530)..(535): a, c, t, g, unknown or other
  misc_feature (530)..(535): n is a, c, g, or t
tcagacgagtgcgtcacgaccggtgctcgatttagatcgtctgtgttgggtttgggggaggcttgataaagcctggggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccgttcaccatctcccgagacaattcgcagaacacgtttgtttttgcaaatggacagcctgagagtcgcggacacggccgtctattattgtgcgacgcgctattataatataggctacgtggggccagggaaccctggtcaccgtctcctcagcctccaaccaacgggcccatccgtccttcccctggccgtccctgcctccgaggacgcacctccgagacgcacgcgccgcctgggctgcctggtacaagctacgttccacgcactcgtcngacgcgggctggcaaggccgacagtacgnnnnnn

SEQ ID NO: 216285 - DNA, 519 bp, Homo sapiens
  misc_feature: GYAE6OF02JFWQF.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaccagggcgagcccctcagatcgtagtctatggtgcatccagacttgcaagggtcggggtcccagtccgaggttcaggtggacagtgcatcgtggacagattacactctcactatcagcagcctgcagcctagaagtatttcgacttaatttattactgtacaacgtagttattagtacgtaccctagtacggtaccgttcggaccgaggggaaccaaggtggaacgtaccacggtaactggtggcctgcctacctatctgtccttacacttccctcctac

SEQ ID NO: 216286 - DNA, 534 bp, Homo sapiens
  misc_feature: GYAE6OF02HGMPO.1.34.D01.1.454.CMB.1.raw
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
  modified_base (419)..(419): a, c, t, g, unknown or other
  misc_feature (419)..(419): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccgaattgacccagtctccatcctcctgtctgcatctattggagacagacgtcaccatccacttgccgggcagtccaggccatcagcgattcttagcctggttgcagcagaaaccagcgcgacgcccctnagactcgtagtctagtggtgcatccagattgcaaggtcgggtccagtccaggttcaggtggctagtcnctagtcgtgggacagtacttaccacttctacgtactatacagtcacgcctagacacgacctagaagtnttttagacttaatttatacgtagtacaactagtattacgtacgtaccctagtcggtacggttcggacgtaagggaacctagggtacggaacttcgaacgtacgtggtagtctacg

SEQ ID NO: 216287 - DNA, 526 bp, Homo sapiens
  misc_feature: GYAE6OF02FORBO.1.34.D01.1.454.CMB.1.raw
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagccttggttgcagcagaaaccagggcgacgcccctcagatcgtagtctagtggtgcatccagattgcaagggtcgggtacccagtccaggttcaggtcggcaggtncatcgtgggacagtacttaacncttctcactatcagcagccctgcacgtcctagaagtattttgacttaatttacttactgtacaactagttattatacgtaccctagtcggtacgttacggccgtagggacctaagggtcgaagttccgaacgtactcggtggtctgtaccg

SEQ ID NO: 216288 - DNA, 637 bp, Homo sapiens
  misc_feature: GYAE6OF02FLG23.1.34.D01.1.454.CMB.1.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (387)..(387): a, c, t, g, unknown or other
  misc_feature (387)..(387): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggtgcagcagaaaccngggcacgcccctnagatcgtagtctagtggtgcatccgagtagttgacgtaagggtcgggtcccatccgaggttcagtggcagtgcagtcgtgggactagtacttacgactctacactanacgagacacgcctgccagcctagtaagtactttttagactttaagttttacttacgttagttaacctaagttaagtttaatttaacgttaaccgtttaacccccgttaagggtttaccgggtaccggtttacccgggggaacccggtaacggggggtaaaccccgttaaagggggttaacggttaaaccgggttaacccgtaaaacccggttaacggtttacgggtacgggtacctttaccggaaccccg

SEQ ID NO: 216289 - DNA, 568 bp, Homo sapiens
  misc_feature: GYAE6OF02GGRQ1.1.34.D01.1.454.CMB.1.raw
  modified_base (563)..(568): a, c, t, g, unknown or other
  misc_feature (563)..(568): n is a, c, g, or t
tcagacgagtgcgtcacgaccggtgctcgatttagatcgtctgtgttgggtttgggggaggcttgataaagcctggggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccggttcaccatctcccgagacaattcgcagaacacgttgttttgcaaatggacagcctgagagtcgcggacacggccgtctattattgtgcgacgcgctattataatataggctactggggccagggaaccctggtcaccgtctcctcagcctcaccaagggcccatcccgtcttcccctggccgccctgcctccgaggacgccaccctccgagacgcacacggccggcccgtgggcctcggcccgtggtccaaacggtacctaccgttcccgaccgtccaacgttccgtacctggacggccggggctcgggaccaagggccgcgaagtacgnnnnnn

SEQ ID NO: 216290 - DNA, 531 bp, Homo sapiens
  misc_feature: GYAE6OF02FKKQ2.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctcagatcgtagtctatggtgcatacagtattgcgaagggtcgggtcccatccaggttcagtggcagtgcatcgtgggacagattacactctcactatcagcacgcctgccagcctagaatattttggacttaatttattactgtactaactagttattagtacgttacccgttagtcggtacgttcggaccgacggggtaaccgaagggtacggaacgtaccgtaaccggacttcgggtacggtctgaccc

SEQ ID NO: 216291 - DNA, 598 bp, Homo sapiens
  misc_feature: GYAE6OF02IRXM0.1.34.D01.1.454.CMB.1.raw
  modified_base (350)..(350): a, c, t, g, unknown or other
  misc_feature (350)..(350): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccagggcgacgcccctcagatcgtagtctatggtgcatccgagtattgcgaagggtcgggtcccatccaggttcagtgcaggtgcatcgtgggacagtacttacactcncactatcagcacgcctgcacgccgtagtaagttagtttacgacttaaattttacttaacttgtaacaaactagttaatttaacgtacgttaacccctagggttacggtaccggtttcgggaccggaacggggtaaccgtaaggttaacgggaacgttaccgaaccgaacgttcgggtcggtacctacggaccctaacccgtagtaccgttcgttccttacccgtacgtttcccctccccgttcccccg

SEQ ID NO: 216292 - DNA, 530 bp, Homo sapiens
  misc_feature: GYAE6OF02HGD28.1.34.D01.1.454.CMB.1.raw
  modified_base (281)..(281): a, c, t, g, unknown or other
  misc_feature (281)..(281): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctnagatcgtagtctatggtgcatccagattgcgaaggtcgggtcccatccgaggttcagtggcagtgcatcgtgggacagtattacactctcactancancagcctgcagcctagagtattttgacttaattttactactagtactaactagttaattacttaacggtaccccttaggtcggtaaccgttcggaccggacggggacctaagggttacgaagtaccaaccggaacgttggtacggcgtgacc

SEQ ID NO: 216293 - DNA, 554 bp, Homo sapiens
  misc_feature: GYAE6OF02F8TK8.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcagcccctnagatcgtagtctatggtgcatccagattgcaagggtgggtcccatccgaggttcaggtggcagtgcatcgtgggacagattacactctcactatcagcacgcctgcacgctagaagtattttgacttaatttattacgtacgttactaaacgtagttaactttacgtaaccgttacccctagttacggtaaccggttccgggaccgtaagggggtaaccctaaggggtacggaacgttaccgaaaccggtaacgtggtacggtcgtacgtacccg

SEQ ID NO: 216294 - DNA, 532 bp, Homo sapiens
  misc_feature: GYAE6OF02F4IPY.1.34.D01.1.454.CMB.1.raw
  modified_base (281)..(281): a, c, t, g, unknown or other
  misc_feature (281)..(281): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaagggtcgggtcccatccaggttcagtggcagtgcatctgggacagtattacgacttcnctactatcagcagcctgcacgtccgtagtaaacgtacttttggacttaaatttacttacgtgtacaatagtaattataccgtaccctaggtcgtaccggtcggaccgagggaacctaagggtacggtaagtacgtaaccggtaacgtggtacggcgtagacc

SEQ ID NO: 216295 - DNA, 563 bp, Homo sapiens
  misc_feature: GYAE6OF02IYIZE.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctatggtgcatccagattgcaaggtcgggtccatccaggttcagtgcagtgcatctgggacagacttacactcacgactatcagcagcctgcacgcctagaagtattttgaccttaattttattactcgtactaacgtagtttaattacgttaaacgtacccgttaacggtcgggtaccggttaccgggcccggtaaacggggaacccgtaaagggttacggaaacggttaccgaaacccggtaaccgttggtacgggtacgtcggtaacccg

SEQ ID NO: 216296 - DNA, 606 bp, Homo sapiens
  misc_feature: GYAE6OF02GU9YV.1.34.D01.1.454.CMB.1.raw
  modified_base (224)..(224): a, c, t, g, unknown or other
  misc_feature (224)..(224): n is a, c, g, or t
  modified_base (287)..(287): a, c, t, g, unknown or other
  misc_feature (287)..(287): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggngagtcgaggccatcagcgtattctttagcctggttgcagcaagaaaccagggcgacgcccctnagatcgtagtctagtggtgcatccagtattgacgaagggtcgggtacccagtccgaggttcaggtcggctagtgcagtcgtagggacagtacttacgactcgtacaacttatcgagacacgcctagcgagcctaggtaagttattttaggactttaaagttttacttacgttagtaactaacgttagtttaactttaacgttaaccgttaccccgttacggttacggttaccggttcccgggaaccggtacggggtaaccgtaaggggttacggtaacgtaaccgtaaccggttacgtaggtacggtcgtacgtacccg

SEQ ID NO: 216297 - DNA, 401 bp, Homo sapiens
  misc_feature: GYAE6OF02FWM2G.1.34.D01.1.454.CMB.1.raw
  modified_base (379)..(379): a, c, t, g, unknown or other
  misc_feature (379)..(379): n is a, c, g, or t
  modified_base (385)..(401): a, c, t, g, unknown or other
  misc_feature (385)..(401): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctggggacagattacactctcactatcagcagcctgcagcctgaagattttgcaatttatactgtcaacagtattatagtacccctacgtggacgttcggccagggggaccaaggtggaagtcaaccgaactgtggctgcaccatctgtcttcatcttcccgcatctgaacgcactcgtctgagcgggctggcaaggcncatagnnnnnnnnnnnnnnnnn

SEQ ID NO: 216298 - DNA, 526 bp, Homo sapiens
  misc_feature: GYAE6OF02GDMK9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccgagggcgagcccctcagatcgtagtctagtggtgcatccagattgcaaggtgggtcccatccaggttcagtggcagtgcatcgtagggacagattacgacttcactactatcagcagcctgcagtcctagtaagtacttttagactaatttattactgtacaactagttactaataccgtaccctagtcggtacgttccggaccgaacggggtaccaagggttacggaacgtacgaaccgtacgtgtcggactggacc

SEQ ID NO: 216299 - DNA, 529 bp, Homo sapiens
  misc_feature: GYAE6OF02GHX1H.1.34.D01.1.454.CMB.1.raw
  modified_base (281)..(281): a, c, t, g, unknown or other
  misc_feature (281)..(281): n is a, c, g, or t
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtgcatccagattgcaagggtcgggtcccatccgaggttcagtggcagtgcatcgtgggacagtattacactctacactatcagcagcctgcagcctagaagtntttgacttaatttattactgtacaactagttaattactaacgtaccctagtcggtaccgttcggaccgaacggggtacctaagggtacggaacgtaccgaaaccggtaacgtggtacgtacctgaaccc

SEQ ID NO: 216300 - DNA, 515 bp, Homo sapiens
  misc_feature: GYAE6OF02GASD8.1.34.D01.1.454.CMB.1.raw
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagactcgtagtctatggtncatccagattgacaaggtcgggtcccatccaggttcagtggcagtgcagtcgtgggacagtattacactctacactatcagcagcctgcagcctagaagtattttgacttaatttattactgtacaacgtagttattaatacgtacccgtagtcgtacgttcggcgtagggacctaaggtggtaacgtccgaacgtacgtggtacggactcgacc

SEQ ID NO: 216301 - DNA, 503 bp, Homo sapiens
  misc_feature: GYAE6OF02GGD32.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccaggggcgagcccctcagatcgtagtctatggtgcatccagattgcaaggtcgggtcccatccaggttcagtggcagtgcatctgggacagattacactctcactatcagcagccctgcagcctagaacgtattttgactaattttattactgtacaactagttaattataccgtaccctacgtcggacgttccgccgaaggggaccaaggtgaagtcgaacgactggtcggctgacc

SEQ ID NO: 216302 - DNA, 389 bp, Homo sapiens
  misc_feature: GYAE6OF02H8S6V.1.34.D01.1.454.CMB.1.raw
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (384)..(389): a, c, t, g, unknown or other
  misc_feature (384)..(389): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgctaatttattactgtcaacagtattatacgtacccctagtggacgttcggccaggggaccaaggtggaagtcaaccgactgtggctgcaccatctgtcttcatccttccgcatctgaacncactcgtctgagcgggntggcaaggcgnatgnnnnnn

SEQ ID NO: 216303 - DNA, 520 bp, Homo sapiens
  misc_feature: GYAE6OF02FZZ02.1.34.D01.1.454.CMB.1.raw
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (373)..(373): a, c, t, g, unknown or other
  misc_feature (373)..(373): n is a, c, g, or t
  modified_base (394)..(394): a, c, t, g, unknown or other
  misc_feature (394)..(394): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcacgcccctnagatcgtagtctatggtncatccagtattgacgaaggtgggtcccatccaggttcagtggcagtgcatcgtgggacagacttacactctacactatcagcagcctgcagcctgaagtntttgactaagttttactactntacaatattattatacgtaccctagtcgtacgttcggaccgagggacctaagggtcgaagtaccgacgtagtggtggctcggaccacgtactcgttacgtccgttactaccgttccgtcccgtacc

SEQ ID NO: 216304 - DNA, 390 bp, Homo sapiens
  misc_feature: GYAE6OF02HG4PB.1.34.D01.1.454.CMB.1.raw
  modified_base (384)..(390): a, c, t, g, unknown or other
  misc_feature (384)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctacgtggacgttcggccaggggaccaaggtggaagtcaaccgaactgtggctgcaccatctgtcttcatcttccgccatctgaacgcactcgtctgagcgggctggcaaggcgcatagnnnnnnn

SEQ ID NO: 216305 - DNA, 480 bp, Homo sapiens
  misc_feature: GYAE6OF02IF8DC.1.34.D01.1.454.CMB.1.raw
  modified_base (354)..(354): a, c, t, g, unknown or other
  misc_feature (354)..(354): n is a, c, g, or t
  modified_base (434)..(434): a, c, t, g, unknown or other
  misc_feature (434)..(434): n is a, c, g, or t
  modified_base (442)..(444): a, c, t, g, unknown or other
  misc_feature (442)..(444): n is a, c, g, or t
  modified_base (446)..(480): a, c, t, g, unknown or other
  misc_feature (446)..(480): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatgggtgcatccagattgcaaggtggggtcccatccaggttcagtggcagtgcatctgggacagattacactctcactatcagcagcctgcagcctgaagtattttgactaattttatactgtacaactgtaattatacgtacccctagtggtacgttcggccagggggaccaagggtggaagtccaaccgaactgtaggctgcaccatctgtcttcactcttccccncactcgtacgaacgcctaactccgttccgtaggacggtccgggacttagggccgtaaaacggggccgaacaaatacggcngtagcagnnngnnnnnnnnnnnnnnnnnnnnnnnnnnnnnnnnnnn

SEQ ID NO: 216306 - DNA, 497 bp, Homo sapiens
  misc_feature: GYAE6OF02GDQDL.1.34.D01.1.454.CMB.1.raw
  modified_base (280)..(280): a, c, t, g, unknown or other
  misc_feature (280)..(280): n is a, c, g, or t
  modified_base (348)..(348): a, c, t, g, unknown or other
  misc_feature (348)..(348): n is a, c, g, or t
  modified_base (490)..(490): a, c, t, g, unknown or other
  misc_feature (490)..(490): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccagggcgagcccctnagatcgtagtctagtggtgcatccagtattgacaagggtgggtcccagtccaggttcaggtggcagtncatctagggacagtattacactctacactatcagcacgcctgcagcctagaactatttgactaatttattactgtacaactattactataccgtaccctagtgacgttcggcaacgggacaaggtgaagtcgaacgtagtgngctgacc

SEQ ID NO: 216307 - DNA, 730 bp, Homo sapiens
  misc_feature: GYAE6OF02H1UWA.1.34.D01.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtggttgggtttggggcatggacatgagggtcccgctcagctcctgggctcctgctgctctggctcccaggtaccagctcgtgactactccaagttcgacccagtctccactcctcccgtgtctgcatctagttggacgacacgagtcaccatcacgttgccgggcagtcaggccatcagcattcttagctggtgctagcaagaaccgnggcacgccctnagactcgtagtctatggtnctatcgaagtacttcgactaagggtcgggtaccagttccgaggttacgacggttcggactaggttacgctacgttcggacgggactaacggtacttaccacgttctaccaacgttacacgaacgcctaacggtcccttacggccgtaacggtccgtacggtaaacggttaacggttttacggaacctttaaagtttttacttaaccgttacgtaacgttaaaccgttaacgtaaacgtttaacgttaacccgttaaccccgttaacgggttaccgggttaacccggttccgggacccgtaaaccggggttaacccgtaacgggtaacggtaaaccgtccggtaaacccggttacggtacgggtacggtaccgtacggtacccgtaacccggtacgtttcccgtacggtttacccgttacgtaacccggttacccgttaccccgttaccg

SEQ ID NO: 216308 - DNA, 568 bp, Homo sapiens
  misc_feature: GYAE6OF02G5AFR.1.34.D01.1.454.CMB.1.raw
  modified_base (256)..(256): a, c, t, g, unknown or other
  misc_feature (256)..(256): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccagggcgagcccctcagactcggtagtctagtggtgcatccagattgcaagggtcgggtcccatccgaggttcaggtggcagtcgacatcgtgggacagacttacacttctacactatcagcacgcctgacagcctagaacgttattttagacttaaatttacttactgttactaaactagttaacttaactaaccgttaacccgtaggttacggtaccggttacgggcccggtaacggggtaaccgtaacggggttagaacgtacgtaaccggtacgttacggtcgggtactacgtacccg

SEQ ID NO: 216309 - DNA, 634 bp, Homo sapiens
  misc_feature: GYAE6OF02IORF5.1.34.D01.1.454.CMB.1.raw
  modified_base (377)..(377): a, c, t, g, unknown or other
  misc_feature (377)..(377): n is a, c, g, or t
tcagacgagtgcgtcacgaccggtgctcgatttagatcgtctgtgttgggtttgggggagtcagaccctgtcaggacacagcatggacatgagggtccccgctcagcctccgtggggctcctgctgctctggcctcccaggtaccagctgtgacatccaattcgacccagtctccatcctccctgtctgcatctagtggagacagagtcaccatcacgttcggccgggcgagtcaggccatcagcgtattcgttagccgtggttgcacgcaagaaaccgagggaccgacgcccctacgagtacgtacgtagtctagtggtgcatccagtattgacgtaagggtcgggtacccagtccgaggttcgaggtggcaggtnactatcgagggacagtacttacactctacactatcacgcgacgccgtagacctacgtaccgttagtaacgttatttcggaacttaattttacgttacgtagttaaccaaagttagttaacttaacgttaaccggttaccccgttaagggttaccggtaaccggtttcccgggaaccggtaaccggggtaaccgtaagggttaccggtaaacggtcccgtaaaccggtaccggttggtaacggtccgtacgtaacccg

SEQ ID NO: 216310 - DNA, 504 bp, Homo sapiens
  misc_feature: GYAE6OF02F8MY6.1.34.D01.1.454.CMB.1.raw
  modified_base (402)..(402): a, c, t, g, unknown or other
  misc_feature (402)..(402): n is a, c, g, or t
  modified_base (495)..(495): a, c, t, g, unknown or other
  misc_feature (495)..(495): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcagcccctcagatcgtagtctatggtgcatccagattgcaaggtcgggtcccatccgaggttcaggtggcagtgcagtcgtagggacaggattacacttctcactatcagcagcctgaccagcctagaagtntttgactaatttattactgtacaactagttaatatacgtaccctagtcggacgttcgccgacgggaccaaggtggaacgtcgaaccgacgtgnggctgtacc

SEQ ID NO: 216311 - DNA, 509 bp, Homo sapiens
  misc_feature: GYAE6OF02GPRH3.1.34.D01.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctnagatcgtagtctatggtncatccagattgcaaggtcgggtcccatccgaggttcagtggcagtgcatcgtgggacagtattacactctcactatcagcagcctgcagcctgaagtnttttcgactaatttattactgttacaactagtattatacgtaccctagtggacgttcggccgagggtaccaagggtcgaagtccgaaccggtactaggtcgtcgtagtaccg

SEQ ID NO: 216312 - DNA, 691 bp, Homo sapiens
  misc_feature: GYAE6OF02JAUOH.1.34.D01.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtctccactcctcctgtctgcatctagtgganacagagtcaaccnactactacgtcgccggcgacgtacgacgaccactcgacgacgtacttacgttacgtccgttggttcgacgacgacgaacgaacggacgggacggaccgaccctacgacgtacgtacgtacgtactagtacggtacgactactacgagtagtacgtacgtaggtaccgggtaccgtacgtaccgtacggtacgtacggtacggacgtacgtacgtacgtacgtacggtacggtacgaacgtactaacgtactacgtactactactacgacgacgacgtacgtacgtacgacgtacgtacgtaacgttacgtttacgtaacgttaacgtttaacgtttacgttacgtaacgtaacgtaacgttacgttaacgttaaccgttaacccgttacggttacggtaccggtaaccggtaccggtcgaaccggtaacggtaacggtaacggtaacggtaaccgtaaccggtaacggtacgtacggtacg

SEQ ID NO: 216313 - DNA, 537 bp, Homo sapiens
  misc_feature: GYAE6OF02FX4JP.1.34.D01.1.454.CMB.1.raw
  modified_base (330)..(330): a, c, t, g, unknown or other
  misc_feature (330)..(330): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccgagggcgacgcccctcagatcgtagtctatggtgcatccagattggacgaagggtcggggtaccccatccgaggttcaggtggcagtncatcgtgggacagtacttacactctcactatcagcagcctgacacgtcctaggaagttatttgacttaaagtttacttacgtgtacaactagttatttacgaacgttaaccctaggtcggtacgttcggaccgaaggggacctaagggtcgaacgtccaacggatggtgctagcctactattcgtctcttacacttccgtcccgtac

SEQ ID NO: 216314 - DNA, 602 bp, Homo sapiens
  misc_feature: GYAE6OF02FODEB.1.34.D01.1.454.CMB.1.raw
  modified_base (103)..(103): a, c, t, g, unknown or other
  misc_feature (103)..(103): n is a, c, g, or t
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatgggacatgagggtccccgntcagctcctggggctcctgctgctctggctcccaggtaccagctgtgacatccaattgacccagtctccatcctcctgtctgcatctattgganacagagtcaccatcacttgccgggnagtcaggccatcgagcgattctttagccttggttgactagcagaaaccngggcacgcccctnagatcgtagtctatggtcncatccagtattgacgaagggtcgggtcccagtccgaggttccaggtggcagtcgctagtcgtagggactaggtactttaacacctactcctaactactacgaacgcctacggcccttaggccgtacgtacccgtagtaaacggttactttttacgaacgtttaaatttacgtttactacgtaacaactagttaacttaactacggttaccccgtagttcgggaaccgtttcgggacccgtaacggggacctaagggtacggtaacgtcgaaaccggtacgtgggtacgacgttgacccg

SEQ ID NO: 216315 - DNA, 504 bp, Homo sapiens
  misc_feature: GYAE6OF02F8TL5.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcccctggttgcagcagaaaccagggcgacgcccctcagatcgtagtctatggtgcatccagattgacgaaggtcgggtcccatccgaggttcagtggcagtgcatcgagggacagacttacactctactactatcagcacgcctgcagcctagaagtatttagactaatttattactgtacaactagttattatactaccctagtgtacgtcggcgaggacgaaggtacgaagtacgaaccgacgtgtgctgtaccg

SEQ ID NO: 216316 - DNA, 622 bp, Homo sapiens
  misc_feature: GYAE6OF02I119L.1.34.D01.1.454.CMB.1.raw
  modified_base (196)..(196): a, c, t, g, unknown or other
  misc_feature (196)..(196): n is a, c, g, or t
  modified_base (259)..(259): a, c, t, g, unknown or other
  misc_feature (259)..(259): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattgganacagatcaccatccacttgccgggcgagtccaggcccatccagcgattctttagccttggttncagcagaaaccagggcagcccctcagatcgtagtctatggtgcatccgagtattgacgaaggtgggtcccaattccaggttacagtggtcaggtgctacgtcgtggggaacaggtactttaacgaccttcgtacctactaactcgaagccaacggccttggccacggtacccttagaaggttacttttacggaacttaaattttaacgttaacgtggttaacaacgtaagtttaacttaaacttaaccggtaacccctttaggtcggtaaccggttcggtaacccggtaaggggtaccccgtaaaggttacgggtaagttaccgaaacccggtaaaccgtagggtcggtacgtcgtaacccgg

SEQ ID NO: 216317 - DNA, 529 bp, Homo sapiens
  misc_feature: GYAE6OF02G3ZDF.1.34.D01.1.454.CMB.1.raw
  modified_base (267)..(267): a, c, t, g, unknown or other
  misc_feature (267)..(267): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccngggcgagcccctcagatcgtagtctatggtgcatccagattgcaagggtcgggtcccatccaggttcaggtggcagtgcatcgtgggacagattacactctcactatcagcagcctgcagcctgaagtntttgactaatttatactgtacaactagttaattactacgtaccccttaggtcggtacgtttccgggaccgtaaggggaacctaagggttcggaaacgtaccgaaaccggtacgttcggtacggctaggtaacc

SEQ ID NO: 216318 - DNA, 569 bp, Homo sapiens
  misc_feature: GYAE6OF02IPEVI.1.34.D01.1.454.CMB.1.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (560)..(560): a, c, t, g, unknown or other
  misc_feature (560)..(560): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcacccatcacttgccgggcgagtcaggccatcagcgattctttagcctggttgcagcagaaaccgagggcgacgcccctnagatcgtagtctatggngcatccagattgcgaaggtcgggtcccatccgaggtcaggtgcagtgcatcgtgggacagtacttacactctacacttatcagtcacgcctgcaggtcccttaggaacgttacttttcgacttaattttagttacctttagtacctaactagtttaacttaacgttaacgtaccccgttacggttggtaccggtttacgggaccggtaaccggggaccgtaaagggtcggtaacgtacgtaaacccgagtacggtacggntcggtaccc

SEQ ID NO: 216319 - DNA, 594 bp, Homo sapiens
  misc_feature: GYAE6OF02GCP73.1.34.D01.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattctttagcctggttgcagcagaaaccgagggcgacgcccctcagatcgtagtctagtggtgcatccagattgcgaagggtcgggtacccagtccgaggttcagtggctaggtcgcagtcgtagggacagtacttacacttctacacttatacgagcacgcccttagccacgtccgttagaacgttattttcgacttaatttattacgttgttaacctaacgttagtttaacttaacgttaaccgttaaccccgttaggttacggtaccggtttaccgggaccggtaacggggtaaccgtaagggtacggtaaacgtacccgaaacgtaccggttggtacggtactagtacccg

SEQ ID NO: 216320 - DNA, 645 bp, Homo sapiens
  misc_feature: GYAE6OF02HFN9J.1.34.D01.1.454.CMB.1.raw
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgtattctttagcctggttgcagcaagaaaccgngggcgacgcccctnagatcgtagtctagtggtgcatccagtattgacgtaagggtcgggtcccagtccgtaggttcaggtcggctagtcgactagtcgtagggacagtacttacactctactactactcagcacgcctgcgacgcctagtaacttacgttttacgaacttaagttttattaaccgttgttaaaccgtaacgttaacgtttaactttaacgtaacccgtttaaccccgttacgggttaccgggtaccggtttaccggggacccgggttaaccgggggtaacccgttaaaggggttaaccgggtaaaccggttaaccgtaaacccgggttaacgttcgggttaccgggtaccgtacggtaaccccg

SEQ ID NO: 216321 - DNA, 479 bp, Homo sapiens
  misc_feature: GYAE6OF02IMY2D.1.34.D01.1.454.CMB.1.raw
  modified_base (233)..(233): a, c, t, g, unknown or other
  misc_feature (233)..(233): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (451)..(479): a, c, t, g, unknown or other
  misc_feature (451)..(479): n is a, c, g, or t
tcagacgagtgcgtcacgaccggtgctcgattagatcgtctgtgtcgcgggggaaagggccaccctctcctgcagggccactcagagtgttagcaccaacgtagcctggcaccagcagaagcctggccagcctcccaggctcctcatctatggtgcatccatcagggccactggtactcccagacaggttcagtggcagtgggtctgggacagagttcactctcacatcaacngcctgcagtctagaagtattttgctagtttattactgtcagctactttcatactcggcgtggacgttcgggacgaagggaccaggtagaaactacgaaacgtactggtcgactacgccacgtatcgtagttcttacacttcccgtacccctacccttccacgaccgctacgtccgtcgtaggaccgcgggtctcgggacaaggccanagtagctncgnnnnnnnnnnnnnnnnnnnnnnnnnnnnn

SEQ ID NO: 216322 - DNA, 418 bp, Homo sapiens
  misc_feature: GYAE6OF02F0LQL.1.34.D01.1.454.CMB.1.raw
  modified_base (346)..(346): a, c, t, g, unknown or other
  misc_feature (346)..(346): n is a, c, g, or t
  modified_base (389)..(418): a, c, t, g, unknown or other
  misc_feature (389)..(418): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagattttgctaatttattactgtacaactagtattatagtacccctagtggacgttcggccaggggaccaaggtgaagtcaaccgactgtggctgcaccatctgtcttcatcttcccgctatcngaacgcactcgtcagacgcggtctggacgaaggcgcagtacgnnnnnnnnnnnnnnnnnnnnnnnnnnnnnn

SEQ ID NO: 216323 - DNA, 683 bp, Homo sapiens
  misc_feature: GYAE6OF02GUS40.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtccaggccatcagcgattctttagccttggttgcagacaacggaaaaccgagggccgacgccccctagagactcgttagtctagtggtgcactcgagtattgacgtaagggtcgggtacccagtccgaggtttcaggtcggacgtaggtcgacgtagttccggtagggaactagtaacttaaccacgttcctactaacttacgtacgaacgtccaacggcccgttaggaccgtacggtaccttaaggtaaagttttacgttttaccggtaactttaaaagtttttactttaacgttacgtaacctaaacttaaggtttaacttaacgttaaacccgttaaccccgttacggtacgggttaccggttaccgggtaacccggaaacggggtaacccgtaaggggttaaccggaaacgttaccgaaacccggtacgtacgggtcggtacctcggtaaccg

SEQ ID NO: 216324 - DNA, 586 bp, Homo sapiens
  misc_feature: GYAE6OF02H1NJM.1.34.D01.1.454.CMB.1.raw
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
  modified_base (565)..(567): a, c, t, g, unknown or other
  misc_feature (565)..(567): n is a, c, g, or t
  modified_base (569)..(569): a, c, t, g, unknown or other
  misc_feature (569)..(569): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
tcagacgagtgcgtcacgaccggtgctcgatttagatcgtctgtggtttggggtttgggagtcaggccatcgagccgattcctttaggccttggttgctagctaggaaccagggcgagccctcagatcgtagtctatggtgcgattccgagattgcaaggtgggttcccatccgaggttctaaggtggcagtgcagtctgggacagtattacgactctcggactattcgagcacgcgtgcagcctgaactntttgactaattttntactgtcaaactagtaattagtacgtacccctagtggtacgttcggccgtacgggaccaagggtgaacgtacgaaccggacttggtaggctcggactacgtagttccgtaggttcttacgacttaccgttacccgactacgttaccgtacgaaaccgtcctaaacgtcccggttacgtacggtacgggtcccgggacctttagggaacccttaacgggccacggaaacttaggcagaccagntanagagagaganagacgacacngagagacgacgacgacgacgatatangcgaganannnangacatntncgagtagta

SEQ ID NO: 216325 - DNA, 797 bp, Homo sapiens
  misc_feature: GYAE6OF02H1HJU.1.34.D01.1.454.CMB.1.raw
  modified_base (226)..(226): a, c, t, g, unknown or other
  misc_feature (226)..(226): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttggggtttgggggagtcagaccctgtcaggacacagcatggacatgagggtcccgctcaggctcctggggctcctgctgctctggctcccaggtaccagctgtgacatccaattgacccagtctccatcctcctgtctgcatctattggagacagacgtcaccaatcacgtttgccgggngagtcaggccatcagcgattcttagcctggttgcagcagaaccngggcgagcccctnagatcgagtctagtggtgcatccagtattcgacgtaaagggtcggggttacccctagtaccgtaacggtttccaaaggttcgggacctaagggttcgtacctaaacggttccgttacggggggtaacctaacgggttaacgttttaaccggaaccctttccggttacccgtaaccgtttaatttacccggaaacggggttcctaaacggggttcccttacgggtaacccggaacggtcccttaaggggtaaaacgtttacgttttttaacggacctttaaaagttttttaaccgttttaaccggttaggtttaacccttaaaaccgttacgtttaaaccgttttaaagtaaacccggtttaacccccgttaagggtaccggggtttaacccgggttttacccggggaacccgggtaacggggggtaaccccgtaagggggttaacgggtaaaccggtttaccgaaaacccgggttaccggttaccgggtaccggttaccgtacggttaaccccg

SEQ ID NO: 216326 - DNA, 645 bp, Homo sapiens
  misc_feature: GYAE6OF02JZD7L.1.34.D01.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatggagacagagtcaccatccacttggccgggngagtcnggccatcagcgattcttagcctggttgcagcagaaccagggcacgcccctnagatccgtagtctatggncatccagtattgacgtaagggtcgggtccaagttccgtaggttcaggttcggcctaggtcgtactactcggtacgggacaacggtacttaacgacttacctactaacgtatacgtacgcacgtaccgtgaccgagtccgtaagtaacgttagttttacgacgttaaattttaacttaaccgtaggtaacctaacgttaaggtttaaactttaaccgttaaacgtttaccccgttaacgggttcggaacccggtttttccgggaaccggtaaccggggtaaccgtaaacgggttacgggtaaaccgtacggtaaacccgacgtttaggacggtaccgtggtaaaccccg

SEQ ID NO: 216327 - DNA, 671 bp, Homo sapiens
  misc_feature: GYAE6OF02I6J5Q.1.34.D01.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattcgacccagtcctccatcctccctgtctgcatctattggagacagagtcaccatcacttgccggnagtcaggccatcagcgtattctttagccttggttcnctagcaagaaaccngggccgacgcccctanagactcgtagtctatggtacgtccaagtcccgaagtactttaggacgtaaacggggttccgggtaccctaagttcccgaaagggtttcccgtaaggttcggaccgtaaggttggactaacggttccggtaggggacctaagtaacgttacctaccgttccgtacctaactactacacggtacaacgtcccgtacgtacgacgtcccgtagaaacgttgtttacgtacgtaaattttacttacgtactacgtaacctaagttaacttaacgttaccgtaacccgttacggttacgtacggttaccggacggtaacgggtaccggtaaagggttcggtaaaccggtcgtaaaccggtaccgtaggtacgggtaccttagaacccg

SEQ ID NO: 216328 - DNA, 605 bp, Homo sapiens
  misc_feature: GYAE6OF02IQ7RH.1.34.D01.1.454.CMB.1.raw
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagatcaccatcacttgccgggcagtcaggccatcagcgattcttagcctggttgcagcagaaaccagggcgacgcccctnagatcgtagtctatggtncatccagattgacgaagggtcggtccatccgaggttcagtggacagtcgctagtcgtagggacagtattacactctcactactcacgcacgcctaggccagtcctagtaacgttagttttacgaacttaaattttacgtaacgttcgtaaccgtaaagttagttaaactttaacgtaaccgtttaaccccgtacgggttacgggttaaccggttccggggtaaccggaacgggggttaacccgaaagggttaacggtaaccggtaccgtaaaccggtaaccgttcgggttacggaccgttgtaaccccg

SEQ ID NO: 216329 - DNA, 705 bp, Homo sapiens
  misc_feature: GYAE6OF02IGE48.1.34.D01.1.454.CMB.1.raw
  modified_base (301)..(301): a, c, t, g, unknown or other
  misc_feature (301)..(301): n is a, c, g, or t
  modified_base (393)..(393): a, c, t, g, unknown or other
  misc_feature (393)..(393): n is a, c, g, or t
  modified_base (432)..(432): a, c, t, g, unknown or other
  misc_feature (432)..(432): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgacatctattggagacagagtcaccatccacgttcggccggggacgagtcgacggccatcagcgtactttcgtttagccgttggttcgcagcaagaaaccgagggacgacgcccctanacgacgtcgtagtctagtggtacgctactccgagtagttcggacggtaaggggttccgggtaccctacgtccgtaggttcgaggtcggacgnggtcgctacgtcgtgggacagtactacactcctacactntacgagcgacgcctgaccgacggtaccgtagtaagttatttcgtaactttaacgttttacttaaccgtacgttaaccgtaaacgttaacgtttaaacgtttaccgttaaaccgtttacccccggtttaagggttaccggggttaacccggtttcccggggtaaacccgggttaacccggggggtaaacccggtaaagggggtttaaccgggaaaccgttacccgggaaacccggttaaccgttacggggtaccggtaccggtacgtaccccgg

SEQ ID NO: 216330 - DNA, 544 bp, Homo sapiens
  misc_feature: GYAE6OF02FUA38.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagccttggttgcagcagaaaccaggcgagcccctcagatcgtagtctagtggtgcatccagattgcgtaagggtcgggtcccagtccgaggttcagtggcagtgcatcgtgggacaggtacttacactctacgactatcagcagcctgcacgctagaagtatttgacttaatttatacgtgtacaacgtagttaattagtacgtaccccttaggttacggaccgttcggcctaacggggaacctaagggttacggaacgttacccgaaccggtaaccgttgggtcggtacgtagtaccc

SEQ ID NO: 216331 - DNA, 501 bp, Homo sapiens
  misc_feature: GYAE6OF02GBSU5.1.34.D01.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccngggcagcccctnagatcgtagtctatggtgcatccagattgcaaggtgggtcccatccaggttcagtggcagtgcatcgtgggacagattacactctcactatcagcagcctgcacgctagaagtattttgacttaatttatactgttacaactagttatatacgtacccgtagtcgtacgtcggccaacgggtactaaggtacgaagtacgaacgacgtaggtcgtctgacc

SEQ ID NO: 216332 - DNA, 574 bp, Homo sapiens
  misc_feature: GYAE6OF02F68KS.1.34.D01.1.454.CMB.1.raw
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggngagtcaggccatcagcgattcttagcctggttgcagcagaaaccngggcacgcccctnacgatcgtagtctatggtgcatccagattgcgtaagggtcgggtcccagtccgaggttcaggtggcaggtcgacgtatcgtagggactagtacttacactctcactatacagtcgacgcctgacgacgtccgtagtaacgttattttaggaacttaaattttacttaacgtagtacctaactaagttaacttaacgtaccgttaaccccgtaggttacggtaccgttccggaccggtacggggtacctaagggtacgtaagtaccgaaccggtacgttggcggtacgcgtaaccc

SEQ ID NO: 216333 - DNA, 522 bp, Homo sapiens
  misc_feature: GYAE6OF02IO3V4.1.34.D01.1.454.CMB.1.raw
  modified_base (266)..(266): a, c, t, g, unknown or other
  misc_feature (266)..(266): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccngggcagcccctcagatcgtagtctatggtgcatccagattgcaaggtgggtcccatccaggttcagtggcagtgcatcgtagggacagattacactctcactatcagcagcctgcagcctagaagtattttgactaattttacttactagtacaactagttattataacgtaccctagtcggtacgttcggaccgtaacggggtaccaaggttacggaagttccgaaccggtaagttcggtacggtctagtacccg

SEQ ID NO: 216334 - DNA, 608 bp, Homo sapiens
  misc_feature: GYAE6OF02GZR3T.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggcgagcccctcagatcgtagtctatggtgcatccagattgcaaggtcgggtcccatccgaggttcagtggcagtgcagtcgtgggacagtattacactctacactatcacgcacggccctggcacggcctagaaacgtattttaggacttaaattttactttacgtagttaacctaacgttaagttaacttacgttaaccgtaaccccctttaagggttcggtaacccggtttacccgggaacccgggttaacgggggaacccgtaaaggggttacgggaaaccgttacccggtaaaacccggtaacgttacgggttacgggtaccttaggtaacccc

SEQ ID NO: 216335 - DNA, 577 bp, Homo sapiens
  misc_feature: GYAE6OF02GG2TG.1.34.D01.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (377)..(377): a, c, t, g, unknown or other
  misc_feature (377)..(377): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattcttagcctggttgcagcagaaaccngggcagcccctnagatcgtagtctaatggtgctactccagattgcgaaggtcgggtacccatccgaggttcagtggcagtgcatcgtgggacagtatacactctcactancgagcagcctgcagtcctagaacgtattttacggacttaagttttaatacgttagtacaacgttagttaaactttactaacgttaccccttaggttacggtaaccggtttccggaaccggtaacggggtaaccctaagggttacggtaaacggttaccctaaaccgggtaaaccgttcggtacggtacgtaggtaacccc

SEQ ID NO: 216336 - DNA, 404 bp, Homo sapiens
  misc_feature: GYAE6OF02GI1YM.1.34.D01.1.454.CMB.1.raw
  modified_base (355)..(355): a, c, t, g, unknown or other
  misc_feature (355)..(355): n is a, c, g, or t
  modified_base (385)..(385): a, c, t, g, unknown or other
  misc_feature (385)..(385): n is a, c, g, or t
  modified_base (392)..(404): a, c, t, g, unknown or other
  misc_feature (392)..(404): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccagggggaccaagggtggaagtcaaccgaactgtggctggcaccatctgtcttcatcttcccgctatctgaacnctactcgtctgacgcgggctggacaaggcntagtagnnnnnnnnnnnnn

SEQ ID NO: 216337 - DNA, 510 bp, Homo sapiens
  misc_feature: GYAE6OF02G4PYA.1.34.D01.1.454.CMB.1.raw
  modified_base (353)..(353): a, c, t, g, unknown or other
  misc_feature (353)..(353): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (482)..(483): a, c, t, g, unknown or other
  misc_feature (482)..(483): n is a, c, g, or t
  modified_base (485)..(485): a, c, t, g, unknown or other
  misc_feature (485)..(485): n is a, c, g, or t
  modified_base (487)..(510): a, c, t, g, unknown or other
  misc_feature (487)..(510): n is a, c, g, or t
tcagacgagtgcgtcacgaccggtgctcgatttagatcgtctgtgttgggtttgggtaggtcgaggccatcagcgattctttagcctggttgcagcagaaaccagggcgagccctcagatcgtagtctatggtgcatccagattgcaaggtggggtcccatccaggttcagtggcagtgcatcgtgggacagattacactctacactatcagcagcctgcagcctgaagtagttttgactaattttacttactgtacaaactagttattatacgttacccctagtggacgttcggaccgagggaccaagggtgaaacgtccaaaccggaacttggcggtctgacctaacccgntccttgttccttactaactccctttacccccgaccccttaccttacgaccgacctaccgttccgttactacggaccggccggggtctacggggaccgtaaaggggccccntaaacggtggcngancngnncnannnnnnnnnnnnnnnnnnnnnnnn

SEQ ID NO: 216338 - DNA, 750 bp, Homo sapiens
  misc_feature: GYAE6OF02JW389.1.34.D01.1.454.CMB.1.raw
  modified_base (317)..(317): a, c, t, g, unknown or other
  misc_feature (317)..(317): n is a, c, g, or t
  modified_base (520)..(520): a, c, t, g, unknown or other
  misc_feature (520)..(520): n is a, c, g, or t
tcagacgagtgcgtcacgaccggtgctcgatttagatcgtctgtgttgggtttgggggtagtcagaccctgtcaggacacagcatggacatgagggtccccgctcagctcctgggctcctgctgctctggctcccaggtaccagctgtgacatccaattgacccagtctccatccctccctgtctagcattctagttcggagacaggctccaaccatacctagtttcgggaccggggcacgtaccgaggcccaataccggagtccgtatttaccgtttacgtccgttggttacggcagacccgtaacgaaacccggngggaccgtaccggcccccgtagaacgtacgttccggttaacgttctaggtttcgggacgacctacgtaccgtagtacgttacgggaacgttaacggggttccgggtaccctaacggttacccggtaggttacgtacggttcggcgtagtcggtactacgtcggtagggactacgtattacaacgtctaacgactacgtccganaccgtactccgtgtacgacttaccgtaggtaacttacgtttacctaactttaaagttttaccttaagttccgtaacttaacgttaaacgttagttaaccctaacgtttaacccggaccgttaggttaccgggttaccggtaaccggttacggggaaacccgttagggtaaaccggtacgtaacccggttaacggtaaccgttacgggtacggtaccggtacggttacccg

SEQ ID NO: 216339 - DNA, 384 bp, Homo sapiens
  misc_feature: GYAE6OF02GJYBB.1.34.D01.1.454.CMB.1.raw
  modified_base (374)..(374): a, c, t, g, unknown or other
  misc_feature (374)..(374): n is a, c, g, or t
  modified_base (380)..(384): a, c, t, g, unknown or other
  misc_feature (380)..(384): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggtacgttcggccaggggaccaaggtggaagtcaaccgactgtggctgcacatctgtcttcatctcccacctctcacgcactcgtctgagcggctggcaaggcnatacgnnnnn

SEQ ID NO: 216340 - DNA, 644 bp, Homo sapiens
  misc_feature: GYAE6OF02JO89J.1.34.D01.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttcgccgggnagtcaggccatcagcgtattcttagccgtggttncagacaacgaaaccgngggccgacgccccgtagacgtactcgtagtcgtagtgggtcactatccgagtagttacggacgtaagggtcgggtacccagttccgaggttcaggtcggcgtagtcgacgtacgttcgacgggactaggttaacttaccgactttccgtacgtacttacgtaccgtacggacgtacggtcctaggacccgtcgtaccgttagttaacgtacgttttcgaactttaacgttttaactcgttagaacctaagttatttaacgtacgttaaaccggtcccttaaggtcggttaccgttacgggaccgtaacggggaacttaagggtacgtaaccggtacgtaaaccggtacgttaggtccgtacgtcgtaaccg

SEQ ID NO: 216341 - DNA, 697 bp, Homo sapiens
  misc_feature: GYAE6OF02I4SSW.1.34.D01.1.454.CMB.1.raw
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttgggtttgggggagtcagaccctgtcaggacacagcatggacatgagggtccccgctcagctccgtggggctcctgctgctctggctcccaggtaccagctgtgacatccaattcgacccagtctccatccctccctgtctgctatctagttggagacagagtcaccatccacgttcggccgggcgagtcaggccatcgagccgtattcttagccttggttcgcagcgaacgaaacgngggcgacgcccgtnagtactcgtagtcgtagtggtcacacttcagtattcgacggtaacggggtcggtacccaagttccgtaggtttacgaaggttcggacgtaggtcgacgtagttacggtagggaaccgtaggtaactttaccgaccgttactcctaacttactcgaacgtacgacgtacctgacgtacgtaccgttaaggtaacgttacttttcggaactttaacgttttacttaccgtagtaacctaacgttacgtttaacgttaacgtaacccggtttaacccgtacgggttcgggttaaccggttcccgggtaaaccggtaaccgggggtaaacgttaacgggtaaccgggtaacgtaacccggtaaacccggtaaggttacgggtccgggttactccggtaacccg

SEQ ID NO: 216342 - DNA, 511 bp, Homo sapiens
  misc_feature: GYAE6OF02H35CA.1.34.D01.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcacatcacttgccgggcagtcaggccatcagcgattcttagcctggttncagcagaaccngggcgagcccctnagatcgtagtctatggtgcatccagattgcaaggtcgggtcccatccgaggttcaggtggcaggtgcatcgtggggacagtattacactctacactatcagcagcctgccagcctagaagtatttgacttaagttttatacgttagtacaactagttattactacgtaccctagtggtacgttcggaccgtagggaccaaggtcgaagtccaacgactggtcggctgacacgtatctcgttcttcacttcctcccgtac

SEQ ID NO: 216343 - DNA, 581 bp, Homo sapiens
  misc_feature: GYAE6OF02IU5RG.1.34.D01.1.454.CMB.1.raw
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaagggtgggtcccatccaggttcaggtggcaggtgcatcgtgggacagattacactctacactatcagcagcctgccagcctgaaacgttatttcgactaaattttacttacgttgtaccaacgtagttaacttacttacgtaaccccttaggtacggtaccgttccgggaccgaacgggggtacccgtaaagggtacggaacggttaccaaccggtaacgttcgggtcgggtacttacgggacctaacccgagttccgttcgtttaccttactaccgttcccgttcccgtacccg

SEQ ID NO: 216344 - DNA, 604 bp, Homo sapiens
  misc_feature: GYAE6OF02GCD3T.1.34.D01.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcaagaaaccagggcgacgcccctcagatcgtagtctagtggtgcatccagtattgacgaagggtcgggtacccagtccgtaggttcaggttggcagtgactagtcgtagggacagtacttaacactctcaacgtatacgacgtacacgtccctagccacgtcctagtaacgttattttcgacttaattttacttactacgtactaactaagttaattaacgttaccgttaacccgttacggttacggtaccggtttacgggaaccggtacggggtaaccgtaagggttacggtaaacgttaccggtaaaccggtaacggttcggtacgggtaccgtaggtaacccg

SEQ ID NO: 216345 - DNA, 682 bp, Homo sapiens
  misc_feature: GYAE6OF02I4MM2.1.34.D01.1.454.CMB.1.raw
  modified_base (101)..(101): a, c, t, g, unknown or other
  misc_feature (101)..(101): n is a, c, g, or t
tcagacgagtgcgtcacgaccggtgctcgatttagatcgtctgtgttgggtttggggagtcagaccctgtcaggacacagcatggacatgagggtccccgntcagctcctgggctcctgctgctctggctcccaggtaccagctgtgacatccaattcgacccagtctccatcctccctgtctgcattctattggagacagacgtcaaccatccacgttcggaccgggcgagtcgacggccatcgagtcgtatttcttagccgttggttgcagcaacgaaacgagggccgaacgccccctagacgacgtacgtacgttcgtagtcggtcgactagttccgagtattcggacgtaacgggtcgggtaccctacgtacgtaggttcgtaggtcggtcgtagtcgactagtcggtacgggacacgtacttaacctacgtcctacgtaactactccgaacgtaccgacgtccgttacgcgtacggttccgaacgttaagtacttttacggtaaccttaactttttaacgttaaccgttaaaggtaacttaacgtttaagttaccttaaaccgtaaccgttacgggtacgtacccgggtttcgaacccggggtaacggtaaccgaagggtaacgtaacgtaaccgtaaccggtacgttacgggtcgtaccggtacgtaccgtaaccg

SEQ ID NO: 216346 - DNA, 564 bp, Homo sapiens
  misc_feature: GYAE6OF02F74H4.1.34.D01.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttncagcagaaaccngggcacgcccctnagatcgtagtctatggtgcatccagattgcaaggtcgggtcccatccaggttcagtcggcagtgctatcgtagggacagacttacactctactactatcatcacgcctgcagcctagaacgtattttgacttaatttattacgtagtacctaactagttaacttacgtacgttaaccccgtagttacgggttaccggttccggaccggtaacggggaaccgtaagggttaggaaaccggttaccgaaacccggtaacggttcggtacggtaccgtcgtaacccg

SEQ ID NO: 216347 - DNA, 600 bp, Homo sapiens
  misc_feature: GYAE6OF02H0FHC.1.34.D01.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (561)..(561): a, c, t, g, unknown or other
  misc_feature (561)..(561): n is a, c, g, or t
  modified_base (570)..(570): a, c, t, g, unknown or other
  misc_feature (570)..(570): n is a, c, g, or t
  modified_base (582)..(582): a, c, t, g, unknown or other
  misc_feature (582)..(582): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacgttgccgggcgagtcaggcatcagtcgtattcttagcctggttncagcaagaaaccgngggcacgcccctnagactcgtagtctagtggtgcatccaagtattggacgtaagggtcgggtacccagtccgaggtttccgaggttcggactaggtgctatcggtcgggaactaaggtactttaaccgaccttctaccgtaacttactacgacgcctaacggtcccgtagccgtaacgccgttaaggtaaacgttacgttttacggactttaaagtttacgttacgtagtacctaaacgtattacttaacgtacgttaccctaggtccgtaacgttcgaccggtaagggtcctaagggtacgaacgtcaacggtntggcgtctnacctacttcgtnttctctcttcctccgtac

SEQ ID NO: 216348 - DNA, 677 bp, Homo sapiens
  misc_feature: GYAE6OF02FQL0U.1.34.D01.1.454.CMB.1.raw
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttgccggcgagtcaggccatcagcgtattctttagcctggtgcagcaagaaaccgagggcgacgcccctnagatcgtatctagtggtncatccagtagttgcgaagggtcgggtacccatccgaggttcaggtggcagtgactagtcgtacgggaacaggtaacttaaccaccgtctacctaacttactaccgaacggtaccaccggtcccgtagaccgacgttacccgttaagtaaacgtttagtttttacgaacgtttaaacttttaacgtttaaccgttacggttaacctaaacgttaagtttaaactttaaacgttaacccgttaacccccgttagggttaccgggtaaccggtttaccgggaacccgggtaaaccggggtaacccggttaaagggtaccgggtaaacgttaacccggtaaaaccggttaacggttcggttacggtaccgtaggtaacccg

SEQ ID NO: 216349 - DNA, 591 bp, Homo sapiens
  misc_feature: GYAE6OF02JNG9P.1.34.D01.1.454.CMB.1.raw
  modified_base (194)..(194): a, c, t, g, unknown or other
  misc_feature (194)..(194): n is a, c, g, or t
  modified_base (256)..(256): a, c, t, g, unknown or other
  misc_feature (256)..(256): n is a, c, g, or t
tcagacgagtgcgtcacgaccggtgctcgatttagatcgtctgtgttggtttggggagtcagaccctgtcaggacacagcatggacatgagggtccccgctcagctcctgggctcctgctgctctggctcccaggtaccagctgtgacatccaattgacccagtctccatcctccctgtctgcatctattgganacagagtcaccatcacttgaccgggcagtcaggccatcgagcgattcttagccttggttacncagtcagtaaaccagggacacgcccctacacgatcgtagtctagtggtcgctactccagtacttgacgaaggtcgggtcccatccgaggtttcaagtcggcagtcgactatcgtagggacaggacttacactactcgactaatcacgtcagcctgccgtagcctagaagtattttcactaatttacttactgttaaccaaagtacgttaacttacgtaaccgttaccccgtaaggtttcgaaccgtttccggtaacccggtaagggtaacccgtaagggttacgtaaacggtaccgtaaaccggtaacgttcggtacggtaccgttacgaaccgg

SEQ ID NO: 216350 - DNA, 556 bp, Homo sapiens
  misc_feature: GYAE6OF02IG5AH.1.34.D01.1.454.CMB.1.raw
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtncatccagattgacgagggtcgggtcccagtccgaggttcagtggcngngcgatcgtgggacagtatacactctcactatcagcacgtcngcagcctagaagtattttanacttaattttacttacgtagtactaacgtagttaattacgttaacgttaccccgtaggttacggtaccgtttaccgggaccggtaaggggacccgtaagggtacggtaacggtaccgaaccggtaacgttggtacggtctagtacccg

SEQ ID NO: 216351 - DNA, 594 bp, Homo sapiens
  misc_feature: GYAE6OF02GK5TJ.1.34.D01.1.454.CMB.1.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttggccgggnagtcgaggccatcagcgattctttagcctggttgcagcaagaaaccgaggggcgacgccccctnagatcgtagtctagtggtcgctatccagtattcgacgtaacggggttcggggtaccctagtccgtaggttcaggtcggcagtgctagtcgtgggaactagtacttacacgtctactactatcagcacgcctgcagccgtagaagttagttttcgaacttaatttacttacgtacgtactaaacgtagttaacttaacgtaaccgttaccccgtacgggttacggtaccgttcgggaccggtaacggggtaaccgtaagggtacggtaacgtaccgaaccggtacgtcggtacgtcgtacgtaccg

SEQ ID NO: 216352 - DNA, 542 bp, Homo sapiens
  misc_feature: GYAE6OF02GREK5.1.34.D01.1.454.CMB.1.raw
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttncagcagaaaccagggcgacgcccctnagatcgtagtctatggtgcatccagattgcaagggtcgggtccagtccaggttcagtggcagtgcagtcgtgggacagtattacactctcactancagcacgcctgcacgcctagaagtnttttcgacttaatttattactagtactaagtattaattataaccgttacccgtagtcggtacggttccggaccggtaacgggaaccgtaaagggtcggtaacgtaccgaaaccggtacgttggtacggtcgtagtacccg

SEQ ID NO: 216353 - DNA, 548 bp, Homo sapiens
  misc_feature: GYAE6OF02GHMBJ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctatggtgcatccagattgacaaggtcgggtcccatccgaggttcagtggcagtgcatcgtgggacagtattacactctcacttatcacgcagcctgcacgtcctagaagttattttagacttaaatttattactgtacaactagttaacttataaccgttaccctaggtcggtaccggttacggacccggtaaggggaaccgtaagggtacggtaaacgtaccgaaaccggtaacgttggtcggtacgtgtaaccc

SEQ ID NO: 216354 - DNA, 665 bp, Homo sapiens
  misc_feature: GYAE6OF02F887X.1.34.D01.1.454.CMB.1.raw
  modified_base (201)..(201): a, c, t, g, unknown or other
  misc_feature (201)..(201): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacactccaattcgacccagtcctccatccctccctgtctgcatctattgganacagagtccacatctacgttcggccgggcgagtcaggccatcgagcgtattcttagccgttggtgcagcaagaaaccngggcgacgcccctagagactcgtagtctagtggtgcactccagtattgacgtaagggtcgggtacccagtcccgaaggttccaaggtcggctagtcgctagtcgtagggaactagtacttacgaccttcgtacctaactacgtacgacgccacgtccgtcgtaccgacggtaccctaaggtaaacgtttagtttttacggaactttaaagttttactttacggtactaaccgtaaacgttaagttaactttaacgtaaccgttaaccccgttaggttccgggtaaccggtttccgggaacccgggtaaggggtaacccgaaaggggtttccggaaacgttaaccggtaaaccggtacgttagggtacggtaccggtcgtaaccccg

SEQ ID NO: 216355 - DNA, 616 bp, Homo sapiens
  misc_feature: GYAE6OF02JZN9U.1.34.D01.1.454.CMB.1.raw
  modified_base (291)..(291): a, c, t, g, unknown or other
  misc_feature (291)..(291): n is a, c, g, or t
  modified_base (396)..(396): a, c, t, g, unknown or other
  misc_feature (396)..(396): n is a, c, g, or t
tcagacgagtgcgtcacgaccggtgctcgatttagatcgtctgtgttgggtttgggtcatggacatgagggtcccgctcagctcctggggctcctgctgctctggctcccaggtaccagctgtgacatccaattgacccagtctccatcctccctgtctgcatctattggagacagagtcaccatcacttggccgggcagtccaggtccatcagtcgtattctttagccttggttgcagcagaaccgagggcacggcccctcagactcgtagtctagtggtgcagtccagnttgcaggtcgggtcccagtccgtaggtcaggtgcgtagtgctatcgtgggaacaggtattacactcgtactactagtcagtcacgctcgactgacctagtaactntttacggtcttaaacgtttatttactgtactaacttaagttacttaacgttaaccgttacccttaaggtaccggttacggttaccggccggttaaccgggggacgttaaacgggtaggtaccggtaacgtaaccggacgttacggaacgggtcgtaccgtaccgacctaacgttcgttaccgttaccgtttccggttacccttaccccgtaaccgttccc

SEQ ID NO: 216356 - DNA, 436 bp, Homo sapiens
  misc_feature: GYAE6OF02H9FXB.1.34.D01.1.454.CMB.1.raw
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (409)..(436): a, c, t, g, unknown or other
  misc_feature (409)..(436): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaagggtcgggtcccatccaggttcagtggcagtgcatcgtgggacagattacactctcactatcagcagcctgcacgcctagaagttattttgactaattttactactgtacaaactagtaattataccgtaccccgtagtggaccgttcggaccgaaggggaaccagggtacggaacgtacaaccgaatgngcngcacntctgtctnctcctccgctatcngacncnctcgnaggcggngacgngacggacgctanagtnagnnnnnnnnnnnnnnnnnnnnnnnnnnnn

SEQ ID NO: 216357 - DNA, 610 bp, Homo sapiens
  misc_feature: GYAE6OF02FNYMK.1.34.D01.1.454.CMB.1.raw
  modified_base (281)..(281): a, c, t, g, unknown or other
  misc_feature (281)..(281): n is a, c, g, or t
  modified_base (397)..(397): a, c, t, g, unknown or other
  misc_feature (397)..(397): n is a, c, g, or t
  modified_base (426)..(426): a, c, t, g, unknown or other
  misc_feature (426)..(426): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattcttagcctggttgcagcaagaaaccagggcgacgcccctnagatcgtagtctagtggtgcatccagtacttgcgtaagggtcgggtacccagtccgaggtttcaggttcggctagtgacagtcgtgggaacaggtacttaacactctactacttancgagcacgcctgacacgtcctagaacgtnttttcgacttaatttacttacgtagttaactaacgtagtttaacttaacgttaaccgttacccgttacggttacgggtaccggtttaccgggacccggtaacggggtaacccgtaaaggggttaccggaaacgttacccggaaaccggtaacgttacgggtaccgggtaccgtagtaaccccgg

SEQ ID NO: 216358 - DNA, 788 bp, Homo sapiens
  misc_feature: GYAE6OF02HFCIB.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcattctattggagacagacgtcacatcacttggccgggcgagtcacggccatcgagcgtatttcttacgccgttgggttgcagacaacgaaaccgagggacgtaccgcccctacaaggtacttacgtaagtctagtggtcgcacgttaccagtattcggacgtaacggggttccgggtacccaacgtccggtaggttacaagggtcggacgtaggtagacgtacgtcgtaggggtaacctaacggtaacttacctaacgttcccgttaacctaacttacgtaccgacggaccgtacgtaccgttcggaccctaacggtaccgtaggttaaacgtttaattttccggtaacttttaaaacgtttttacgtttaccgtttaacggtaaccctttaaaacgttaagttttaaacctttaaacggttaaaccccggtttaaccccgtttaaccgggttaccggggtaaccggtttttacccggggaaccccgggtaaacggggggtttaaaccccgaaagggggtttaaccggggttaaaacgtttacccgggtaaaacccggtaaccgggttcgggttaccgggttaccgttaccggtaacccgg

SEQ ID NO: 216359 - DNA, 694 bp, Homo sapiens
  misc_feature: GYAE6OF02JWUD5.1.34.D01.1.454.CMB.1.raw
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (540)..(540): a, c, t, g, unknown or other
  misc_feature (540)..(540): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagcagagtcaccatcacttggccgggctagtcaggccatcagctattcttagcctggttncagcagaacagggcacgcccnagatcgtagtctatggtcnctatccagtnttcgcgtaagggtcgggtcccagtaccgacgggtttacaggttcggacgtaggtgtactaacttccggagggtaacctaggtaacctttaacacctttccgtaacctaacgttacttcgaaacgtacgaccgtcctaccgggacaaccgggtaccttaaggtaaagtttcttttaccggaacctttaatttttacttaaccggttgttaaaccctaaagtgtttttaaaaaccttnttaaacccgggtttaccccttaaacggttcggggtaacccggttttaccgggtaaccggaaccggggttaaacccggaacggggtttaacgtaaccgggttaaccaaacccgggttaccgttaaggggtcccgggttataaccccggttaccgg

SEQ ID NO: 216360 - DNA, 567 bp, Homo sapiens
  misc_feature: GYAE6OF02H8GGZ.1.34.D01.1.454.CMB.1.raw
  modified_base (284)..(284): a, c, t, g, unknown or other
  misc_feature (284)..(284): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
  modified_base (558)..(558): a, c, t, g, unknown or other
  misc_feature (558)..(558): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctgggttcgcagcaagaaaccagggcacgcccctnagagtcgtagtctatggtgcatccagattgacgtaagggtcgggtcccagtccaggttcaggtggactagtcgcagtcgtgggacagtactacnctctcactatcacgacacgcctgaccagtcctagtaagttntttagacttaatttacgttactgtaccaacttagttattaacttaaccgtaccccgttaggtacggtaccgttacggccggtaacggggaccgtaaagggttcggaacggttacgaaccggtacgttcgggtacgtacncggtaaccc

SEQ ID NO: 216361 - DNA, 690 bp, Homo sapiens
  misc_feature: GYAE6OF02G0CEN.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttgcagcaagaaaccgagggcgacgcccctcagtatcgtagtctagtggtgcatccagtattggacgtaaggggtcgggtacccagtcccgaggttcaggtcggactaggtcgactagttcggtaggggaactaggtaactttaaccacttcctactaacttactacgaacgtccaacggtcccgtacggacctaacggtacccgttaagtaaacggtttactttttacggaacttttaaactttttaacgttaccgttagttaacctaaacgttaagtttaaactttaaacgttaacccggttaaccccgttaagggttaccggggtaacccgtttccggggaacccggtaaacggggtaacccgtaaaggggttacggtaaacgtaaccgaaaccggttaacgttacgggtacgggtacctacggtaacccg

SEQ ID NO: 216362 - DNA, 801 bp, Homo sapiens
  misc_feature: GYAE6OF02JV0OH.1.34.D01.1.454.CMB.1.raw
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcgagtcaggccatcagcgattcttagcctggttgcagcaagaaccgagggccgacgcccctnagtatccgtagtcctagtaggtncatccagtattgacgtaagggtcgggtcccagtcccgtaggttcaggtggaccaaggttcgacgtacgttcggtacggggtaactaacgggtaatttaacccgtaaccgttccttacccggtaaccctttaaattacccgttaaaacggcccgtaaccgggtaccctttacgggaccctaaaccgggttaccccgttaacgggttaaacggttttaaaccgtttttttaccgggaaaccgtttttaaaacttttttaaccggttttaaacccttttacgggttaaaccgtaaaacccgtttaaagggttttaaactttaaaaccgtttaaacggtttaccccccgttaaaccggggttcggtttaaaccccgggtttaaccggggtacccccgggtaaaaggggttacccggggtaaaacgttaaccggggtaaccgttaaacccgtaacccgggtaaacgggttcgttacggggtacccttaccggtaaccccgg

SEQ ID NO: 216363 - DNA, 560 bp, Homo sapiens
  misc_feature: GYAE6OF02GIVMK.1.34.D01.1.454.CMB.1.raw
  modified_base (261)..(261): a, c, t, g, unknown or other
  misc_feature (261)..(261): n is a, c, g, or t
  modified_base (400)..(400): a, c, t, g, unknown or other
  misc_feature (400)..(400): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagacaagaaaccgaggggcgacgcccctnagatcgtagtctagtggtgacactccagtattgacgtaaggggtcggggtacccatcccgaggttccgaggtggcaggtcgcagtcgtgggacagtacttacactctcactatcagcacgcctgcagtcctagaacgtntttagacttaatttattactgtacaactagtattatacgtacccgtaggtcggtacgttcggacgacggggactaggtagaacgtacgaaccgtacgtggtcggactcgacctaccgtattccgttacgttccttacgtaccgttcccgtacccgtaccg

SEQ ID NO: 216364 - DNA, 394 bp, Homo sapiens
  misc_feature: GYAE6OF02GFJZG.1.34.D01.1.454.CMB.1.raw
  modified_base (363)..(363): a, c, t, g, unknown or other
  misc_feature (363)..(363): n is a, c, g, or t
  modified_base (381)..(394): a, c, t, g, unknown or other
  misc_feature (381)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggacgttcgccaggggaccaaggtgaagtcaacgaactgtgctgcacatctgtcttcatccttccgcatctgaacgcactcgtctggacgcgggntcgggcaaggcacatagnnnnnnnnnnnnnn

SEQ ID NO: 216365 - DNA, 533 bp, Homo sapiens
  misc_feature: GYAE6OF02GBZRJ.1.34.D01.1.454.CMB.1.raw
  modified_base (197)..(197): a, c, t, g, unknown or other
  misc_feature (197)..(197): n is a, c, g, or t
  modified_base (378)..(378): a, c, t, g, unknown or other
  misc_feature (378)..(378): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgatctttagcctggttgcagcagaaaccagggcagcccctcagatcgtagtctatggtgcatccagattgcaaggtgggtcccatccaggttcagtggcagtgcatctagggacagtattacactctacactatcagcancctgcagcctagaagtattttgactaatttattactgtactaactagtaatttatacgtaacccgttacgtacgtacggttaccggccgaacggggaaccgtaagggtacggtaacggtaccgaaaccggtaacgtggtacgggtcgtagtaccg

SEQ ID NO: 216366 - DNA, 510 bp, Homo sapiens
  misc_feature: GYAE6OF02F4F9I.1.34.D01.1.454.CMB.1.raw
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccataacttgccgggcagtcaggccatcagcgattcttagcctggttgcagcagaaaccagggcgagcccctnagatcgtagtctatggtgcatccagtattgcaaggtggggtcccatccaggttcagtggcagtgcatctgggacagattacactctcactatcagcagcctagcagcctagaacgtattttgacttaattttacttacttgtacaactagttattaatacgtaccctagtcggtacgttcggaccgagggaccaaggtggaacgtacgaaccgacgtgtggctgactaccg

SEQ ID NO: 216367 - DNA, 548 bp, Homo sapiens
  misc_feature: GYAE6OF02GI1QX.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctagtggtgcatccagtattgcgaaggtcgggtcccagtccaggttcagtggcagtgcatcgtgggacagattacactctcactatcagcagcctgcacgctagaatattttgacttaatttattactgtactaacgtagttaattacgtacgtacccctaggttacggtaccggttcggaaccggtaacggggtaaccgtaagggtacggtaaacgtaccggaaccgtaacgttacggtacggtacgtacggaccg

SEQ ID NO: 216368 - DNA, 543 bp, Homo sapiens
  misc_feature: GYAE6OF02GBWTP.1.34.D01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
tcagacgagtgcgtcacgaccggtgctcgatttagatcgtctgtgttggttttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggngagtcaggccatcagcgattcttagcctggtgcagcagaaccgagggcacgcccctnagactcgtagtctatggtncatccagattgacgaagggtcgggtccctagtccgaggttcagtggactaggtcgcagtcgtagggacagtacttaaccacttcctactaacttatcgagccacgtcctggcagtcctagaagttattttcgacttaatttacttactgtacaagtagttaattacgtacgtacccgtagtggtaccgttcggacgaacgggaccaagggtacgaacgtccgaacgtacgtggtcggtctgtacc

SEQ ID NO: 216369 - DNA, 609 bp, Homo sapiens
  misc_feature: GYAE6OF02JIYDZ.1.34.D01.1.454.CMB.1.raw
  modified_base (383)..(383): a, c, t, g, unknown or other
  misc_feature (383)..(383): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggtaggtcgagaccctgtcaggacacagcatggacatgagggtcccgctcagctcctggggctcctgctgctctggctcccaggtaccagctgtgacatccaattgacccagtctccatcctcctgtctgcatctattggagacagagtcacatcacttgccgggcagtccaggccagtcagcgattctttagccgttggttcgctagcagaaaaccgagggcgacgcccctcgacgatcgtagtctagtggtgacatccagtattgacgtaaggtcgggtcccagtccgaggttcaggtcggcagtcgcagtcgtggacagatacnctctacgactagcancgacgcctancgacgtcctagaagttacttttcggacttaagttttaacttacgttcgttaacaacttacgttaattaacgttacgtaacccgttacggttacggttaacggtttaccggaccggtaacggggttaacccggtaaaggtaccgggttaaacgttaaccggaaccggtaaaccggttcggtacgggtacctacggtaacccg

SEQ ID NO: 216370 - DNA, 679 bp, Homo sapiens
  misc_feature: GYAE6OF02HPK89.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatggagacagagtcaccatcacttggccgggcgagtcaggccatcagcgtattctttagcctggttgcagcaagaaaccagggcgagcacctcagatcgtagtctagtggtacgctactccaagtacttggacgaaagggttcggggtaccccagtcccgtaaggtttcgaaggtcgggacgtaggtgacctaacgttcggtacggggaaccgtaaggttaactttaccaaccttctaacctaacttaactacgacgtaccacgtccgtacgaccgtaacggtccctagtaaacgttagtttttacgactttaaacgttttacttaccgttagtaacctaaacgtagtttaactttaaacgttaccgttaaccccgttacgggttacggttaacccggttaccgggacccgggtaaacgggggtaacccgttaaagggtaccggtaaacggtacccgaaaaccggttaacgtcggtacggccgtaacgg

SEQ ID NO: 216371 - DNA, 582 bp, Homo sapiens
  misc_feature: GYAE6OF02HWOJY.1.34.D01.1.454.CMB.1.raw
  modified_base (281)..(281): a, c, t, g, unknown or other
  misc_feature (281)..(281): n is a, c, g, or t
  modified_base (414)..(414): a, c, t, g, unknown or other
  misc_feature (414)..(414): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgatttcttagcctggttgcagcaagaaaccagggcgagcccctnagatcgtagtctagtggtgctatccagattggcgaaaggggttcgggtccccagtccgaggtttcaaggtggcagtgcatcgtgggacagtattacacttctctaactatcagcagcctggcagcctagaatnttttagacttaaattttattactgttacaactagtttaacttacgtaaccgttaccccttaaggttcgggtaaccgtttacccgggacgtaaccgggggaaccttaaggggtacggtaaacggtccgaaaccgggtaaccgttcgggtacggtacttacggtaacccg

SEQ ID NO: 216372 - DNA, 506 bp, Homo sapiens
  misc_feature: GYAE6OF02FOP0N.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcagcccctcagatcgtagtctatggtgcatccagattgcaaggtcgggtcccatccaggttcaggtggcagtgcatcgtgggacagattacactctcactatcagcacgcctgcacgcctagaagtattttacgacttaatttattactgtacaatagtattatacgttaccctagtcggacgttcggccgaggggaccaagggtacgaagtaccgaacgtacgtgtcggctgacc

SEQ ID NO: 216373 - DNA, 603 bp, Homo sapiens
  misc_feature: GYAE6OF02FTJ49.1.34.D01.1.454.CMB.1.raw
  modified_base (294)..(294): a, c, t, g, unknown or other
  misc_feature (294)..(294): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtccaccatcacttcgccgggcgagtcaggccatcagcgtattctttagccgtggttcgcagacgaacgaaaccgaggggccgacgccccctnagatcgtagtctagtggtgctatccagattgacgagggtcgggtcccagtccgagttcgaggtcggcagtcgctagtcgtgggacagtactacactctacactatcgagcancctgcacgcctagtaagtnttttacgacttaaattttacttacgtacgtaactaactacgttaatttaacgttaacccgttaaccccgttagggttaccggtaccggttacgggacccggtaagggggtaacccgtaaggggtaccggtaacggtacccgaaaccggttaccgttgggtacggtcctacggtacccg

SEQ ID NO: 216374 - DNA, 390 bp, Homo sapiens
  misc_feature: GYAE6OF02HAGDS.1.34.D01.1.454.CMB.1.raw
  modified_base (349)..(349): a, c, t, g, unknown or other
  misc_feature (349)..(349): n is a, c, g, or t
  modified_base (382)..(390): a, c, t, g, unknown or other
  misc_feature (382)..(390): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtcaaacagtaattatacgtacccctagtggacgttcggcaggggaccaaggtgaatcaaccgatgtggctgcacatctgtctcatcttccgcatctgaacncattcgtctgagcgggctggacaggcacatagnnnnnnnnn

SEQ ID NO: 216375 - DNA, 614 bp, Homo sapiens
  misc_feature: GYAE6OF02IJI4N.1.34.D01.1.454.CMB.1.raw
  modified_base (258)..(258): a, c, t, g, unknown or other
  misc_feature (258)..(258): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcattctattggagacagagtcaccatcacttggccgggcagtcaggccatcagcgtattctttagccttggttncagcaacgaaaccgagggccgaacgccccctcgagacttcggtagtctagtgggtgcatccagtattcgcgaagggtcgggtacccatccgtaggttcaggtcggacagtgactagtcgtacgggaacagtaacttacgtacctactactaactaacgttacaacgccgaacgtccctggaccgacgcccttaagaacgttattttacgacttaaattttacttacttagtacctaaacgtagtttaattaacttaacgtacccttacgggtacggtaccggttcggaaccggtacggggtaacctaagggttacggaagtacccgaaccggtacgtaggtcggtacgtgtacccg

SEQ ID NO: 216376 - DNA, 633 bp, Homo sapiens
  misc_feature: GYAE6OF02GQSDS.1.34.D01.1.454.CMB.1.raw
  modified_base (418)..(418): a, c, t, g, unknown or other
  misc_feature (418)..(418): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagagtcaccatcacttcgccaggcgagtcaggccatcagcgtattctttagccttggttcgctagacaaggaaaccgaggggccgacgcccctacgagactcgtagtactagtgtgctactaccgagtattcgacgtaacgggtcggggtccctacgtccgtaggttcaggtggcagtgactacgtcgagggactagtacttacacttctactactancaggcacgccgtgccgagtcctagaacttacgtttgaacctttaattttactaccgttactaactaaacgtaagtttacttaaaccgttaccgttaaccccgttagggtaccggtttaacccgggttaccgggaacccggtaaacgggggtaaccgtaaagggggtacgtaaacggtacccgtaaaccggtacggtacggttacgggtctaacgg

SEQ ID NO: 216377 - DNA, 644 bp, Homo sapiens
  misc_feature: GYAE6OF02GHAYQ.1.34.D01.1.454.CMB.1.raw
  modified_base (275)..(275): a, c, t, g, unknown or other
  misc_feature (275)..(275): n is a, c, g, or t
  modified_base (637)..(637): a, c, t, g, unknown or other
  misc_feature (637)..(637): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctatcggagacagagtccaccatcacgttgccgggcgagtcacggccatcagcgtattctttagcctggttcgcagcaggtaaaccgngggcgacgcccctgagatcgtagtctagtggtcgacatccgagtattcggacgtaaggggtccggtacccagtcccgtaggtttccgaggtcgcgagttcggactaagttcgtacgggaactaggtactttaacgaccttacgtacgtacttagtaccgagtcaaccgtccgtacgactaacgtcccgtaagtaacgttattttacggactttaaatttttacgtacgttagtaactaacgttagttaacttaacgttaccgttaaccccttagggttacggtaccgtttaacgggcccggtaaacgggtaccggtaaggtacggtaaaccgtacaaacccggttaagtcggtaggtacccnggtaccc

SEQ ID NO: 216378 - DNA, 602 bp, Homo sapiens
  misc_feature: GYAE6OF02G4LJ9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctccccaggtaccagctgtgacatccaattgacccagtctccatcctccctgtctgcatctattggagacagagtcaccatcacttgccgggcagtcaggccatcagcgtattctttagcctggttgcagcagaaaccagggcgagcccctcagatcgtagtctatggtgcatccagattgcaagggtcgggtcccatccaggttcagtggcagtgcagtcgtgggacagtattacactctcatatcagcagcctgcgacgtaccgtagaagttattttaggacttaaagttttactttactacgttaactaacttaagtttaactttaacgttaaccgttaaccccgttacggtacgggtaaccggtttaccgggacccggtaacggggggtaaaccctaacggggtttaacgggaaccggttaaccgaaacccggtacgtttacgggtacgggtaccgttaggtaacccc

SEQ ID NO: 216379 - DNA, 396 bp, Homo sapiens
  misc_feature: GYAE6OF02ILJOM.1.34.D01.1.454.CMB.1.raw
  modified_base (384)..(384): a, c, t, g, unknown or other
  misc_feature (384)..(384): n is a, c, g, or t
  modified_base (389)..(396): a, c, t, g, unknown or other
  misc_feature (389)..(396): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgacaatttattactgtcaaacagtaattatagtacccctacgtggacgttcggccaggggaccaagggtggaagtcaaccgatgtggctgcaccatctgtcttcatcttcccgccatctagaacgcactcgtctgagcgggctggacaaggcgnatagnnnnnnnn

SEQ ID NO: 216380 - DNA, 698 bp, Homo sapiens
  misc_feature: GYAE6OF02IL9EM.1.34.D01.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (687)..(687): a, c, t, g, unknown or other
  misc_feature (687)..(687): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctcctgtctgcatctattgganacagagtcaccatcacttgccgggcgagtcaggccatcagcgtattctttagcttggtgcagcaagaaaccngggccacgcccctcagntcggtagtctagtcggtgctactccgagtattcgacgaaggggttcggggtacccctaacgtaccgacggtttcaggttacggacgtaggttcgacctagttccggtagggaacaggtaacttaccacgttctacgtattacncgacgtctacgccgtagaccncgtcctaaggaacgtttacgttttacggtaaccttaaagtttttaaccgttaaccttacgttaacgtaaacgtttagttaaacttttaaacgttaaacccggttaacccccgttaacgggtttacgggtaacccggttttacccgggggaaccggttaaaccgggggtaacccgtaaacggggttaaccgggtaaccgttaaccgaacccgggttaaggttcgggtacggttacccnggtaaaccccg

SEQ ID NO: 216381 - DNA, 516 bp, Homo sapiens
  misc_feature: GYAE6OF02GA94U.1.34.D01.1.454.CMB.1.raw
  modified_base (281)..(281): a, c, t, g, unknown or other
  misc_feature (281)..(281): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctnagatcgtagtctatggtgcatccagattgcgaaggtcgggtcccatccaggttcagtgcagtgcatcgtgggacagtattacactctcactatcagcacgcctgcagcctagaagttntttcgacttaatttacttctatacaactagtaattacgtacgtacccctaggtcgtacgtcggcgaacgggtactaaggtagaacgtacgaaccgtacgtggtacggtctagtaccg

SEQ ID NO: 216382 - DNA, 480 bp, Homo sapiens
  misc_feature: GYAE6OF02FX0XK.1.34.D01.1.454.CMB.1.raw
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctacatatcagcagcctgcagcctagatattttgactaatttattactgtacaactagtaattatacgtaccctagtgacgtcgcgaggacaaggtgagtcaacgatgngctgacc

SEQ ID NO: 216383 - DNA, 653 bp, Homo sapiens
  misc_feature: GYAE6OF02GZQOT.1.34.D01.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttgcagcaagaaaccagggcgacgccccctnacgatcgtagtctagtggtgcatccagtattgcgtaagggtcgggtcccatccgaggttcagttggcgagtcgcgagtcgtgggacaggacttaccattcctactactatcgagtacacgcctgacctacgaccttagaaacgttattttacggacttaaattttaacttaacgtttgttaacctaaaccgttaagtttaacctttaacgttaaccgttaacccccgttacgggttacggtacccggttttaccgggacccggtaaaccgggggtaaacccgttaaagggggttaaccggtaaaccgttaaccgtaaacccgggtaaaccgttttcgggtaaccgggttaccttccggggtaaaacccc

SEQ ID NO: 216384 - DNA, 486 bp, Homo sapiens
  misc_feature: GYAE6OF02IGD4F.1.34.D01.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (389)..(389): a, c, t, g, unknown or other
  misc_feature (389)..(389): n is a, c, g, or t
  modified_base (460)..(461): a, c, t, g, unknown or other
  misc_feature (460)..(461): n is a, c, g, or t
  modified_base (463)..(486): a, c, t, g, unknown or other
  misc_feature (463)..(486): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatcgtgggacagattacactctcactatcagcagcctgcagcctagaagtnttttgctaattttatctgtccaaatgttaattanacgttacccctagtggtacgttcggaccgaaggggaccaagggtggaaatcaaccgtaactggtcggactcggacctaacctatccgtagttccttacaacttcccttcccccgaccttccccgtanaccgtactacccgttccggtactcgggacggtccgggtctacggggacgtaaacgggcctactaacgtgcnncnnnnnnnnnnnnnnnnnnnnnnnn

SEQ ID NO: 216385 - DNA, 585 bp, Homo sapiens
  misc_feature: GYAE6OF02FQ8QG.1.34.D01.1.454.CMB.1.raw
  modified_base (301)..(301): a, c, t, g, unknown or other
  misc_feature (301)..(301): n is a, c, g, or t
  modified_base (386)..(386): a, c, t, g, unknown or other
  misc_feature (386)..(386): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccagggcacgcccctcagatcgtagtctagtggtncatccagtattgcaagggtcgggtcccatccgaggttcaggtcggactagtgctatcgtgggacagtattacacttctacactanacagcagcctgcagcctagaagttcttttggacttaaattttacgttacttagtacctaacttaagttacttaacgttacgtaccccgttaaggtcggtaacggtttccgggaccggtaagggggaacccgttaaggggtacggtaaacggttacccgaaaccgggttaaccgtggtaccgggtaccgtacgtaacccg

SEQ ID NO: 216386 - DNA, 534 bp, Homo sapiens
  misc_feature: GYAE6OF02IHX8A.1.34.D01.1.454.CMB.1.raw
  modified_base (296)..(296): a, c, t, g, unknown or other
  misc_feature (296)..(296): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgagacagagtcaccatcacttgccgggcagtcaggccatcagcgattctttagcctggttgcagcaagaaaccagggcagcccctcagatcgtagtctatggtncatccagattgacaaggtcgggtacccagttccaggttccagtcggctagtgacatcgtgggacagtacttacgactcgtacactatacagcagcctgctacgccttagaacgtattttagacttaatttaattactgtactaactagttaactttaactaaccgttaccctacgtggacgttcggactacggggaacaagggtgaagtaccaaccgtagtcggtagtaccgtgaccc

SEQ ID NO: 216387 - DNA, 387 bp, Homo sapiens
  misc_feature: GYAE6OF02IB88Q.1.34.D01.1.454.CMB.1.raw
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
  modified_base (382)..(387): a, c, t, g, unknown or other
  misc_feature (382)..(387): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaattttattactgtcaacagtattatagtacccctagtggacgttcggccagggggaccaagggtggaagtcaaccgaactgtggctgcacatctgtctcatctccgcatctgaacncactcgtctgacgcggctggcaaggcncatgnnnnnn

SEQ ID NO: 216388 - DNA, 581 bp, Homo sapiens
  misc_feature: GYAE6OF02HHLDM.1.34.D01.1.454.CMB.1.raw
  modified_base (195)..(195): a, c, t, g, unknown or other
  misc_feature (195)..(195): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctatgganacagagtcaccatcacttgccgggcagtcaggccatcagcgtattctttagcctggttgctagcagaaaccagggcgagcccctcagatcgtagtctatggtgcatccagattgacaaaaggtcggggtacccagtccgtaaggttcgagtacggcgacgtagtacagtcgtacggacgagtataactactctcactactanacgacacgtctcgacagtcctagtaagtattttagtactaattttaattacctagtactaaactacgttaatttaactaacgtaacccgttacgttacggtacggtttaccggaccggtacgggtaacggtaacggttacggtaagtaccgtaaccggaacgttaggtacggcgtacgtacccg

SEQ ID NO: 216389 - DNA, 577 bp, Homo sapiens
  misc_feature: GYAE6OF02IAE7I.1.34.D01.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggaaacagcatggacatgagggtccccgctcagctcctggggctcctgctgctctggctcccaggtaccagctgtgacatccaattgacccagtctccatcctccctgtctgcatctattgganacagagtcacatcacttgccggngagtcaggccatcagcgattcttagcctggtncagcaagaaaccngggcacgcccctnagatcgtagtctatggtnctancagtattcgacgaagggttcgggcccagtccgtagggttccaggttggacaggttcgactatcggtggggaactagtactttaacgacttcgtaccacttaacncgacgcacgtctgacacgtactagtaagttatttacactttaatttactactacgtaactaagtagttattaacgtaaccgtacccgtaggtacggtaccgtcggaccggtaacgggaacgtagggtacgtaacgtaccgtaacggtacgttaggtaccggtctacgactacg

SEQ ID NO: 216390 - DNA, 676 bp, Homo sapiens
  misc_feature: GYAE6OF02IUJTC.1.34.D01.1.454.CMB.1.raw
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggccgagcccctnagtatcgtagtctagtggtncatccagtattgacgtaaggggtcggggtaccccagttccccaagggtttccaagggttcggccgtaaggttcggactacgttccgttagggggaacctaggtaactttacacttaccttccaacttatccgacggtccacggtcccttggaccctaggtaccccttaggtaaacgtttagtttttacgaacgtttaaatttttaacctttacgttacgttaacctaaacgttacgtttaaactttataaccgttaacccccgttaggtaccgggtaaccgtttccgggtaacccggaacggggtaaccgtaaggggttacggaaaccgttaccgaaacccgggtaagttccgggtacggtacgtcgtaacccg

SEQ ID NO: 216391 - DNA, 395 bp, Homo sapiens
  misc_feature: GYAE6OF02F19DI.1.34.D01.1.454.CMB.1.raw
  modified_base (381)..(381): a, c, t, g, unknown or other
  misc_feature (381)..(381): n is a, c, g, or t
  modified_base (388)..(395): a, c, t, g, unknown or other
  misc_feature (388)..(395): n is a, c, g, or t
tcagacgagtgcgtcacgaccggtgctcgatttagatcgtctgtgttgggtttgggagtcaggccatcagcgattctttagcctggttgcagcagaaaccagggcgagccccctcagatcgtagtctatggtgcatccagattgcaaggtggggtcccatccaggttcagtggcagtgcatctgggacagattacactctcactatcagcagcctgcagcctgaagattttgcaatttatactgtcaacagtattatagtacccctagtggaccgttcggccaggggaccaaggtggaagtcaaccgaactgtggctgcaccatctgtcttcatccttcccgccatctgaacgcactcgtctgagcgggctggcaagggcncaatagnnnnnnnn

SEQ ID NO: 216392 - DNA, 695 bp, Homo sapiens
  misc_feature: GYAE6OF02JYVTV.1.34.D01.1.454.CMB.1.raw
  modified_base (143)..(143): a, c, t, g, unknown or other
  misc_feature (143)..(143): n is a, c, g, or t
  modified_base (198)..(198): a, c, t, g, unknown or other
  misc_feature (198)..(198): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattgacccagtcctccatcctccctgtctgcattctatgganacagatcaccatcacttcggccggcgagtacaggccagtcagcgtatttcttacgtccgttcggttgacgagacaacggaaccgagggaccgtaacgccccgtacgaagtacgtacgtaacggttctacgtggtcgactatccgaagagtttcggacgtaacggggttcgggtacccacttccgaggttcgtaggtcggtagacgtacgtctaacggttcgcgggaactagtacctacgtactcgtacaacgtactcgaagtacgtacgaccgtgtaccacgtacctaggtaaagttacttttacgtacgttaaatttttacgtacgttacgtaacgtaacgtttaagttaacgttaaaccgtaaccgttaaccccgttcgtacgggttaaccgggttccggtaaaccggggtaacgggtaacccggtaaagggttacgggtaaaactcccggtaaaacccgggttacgttacggtacgggtaccttaaggaccccg

SEQ ID NO: 216393 - DNA, 591 bp, Homo sapiens
  misc_feature: GYAE6OF02I84X7.1.34.D01.1.454.CMB.1.raw
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (416)..(416): a, c, t, g, unknown or other
  misc_feature (416)..(416): n is a, c, g, or t
  modified_base (454)..(454): a, c, t, g, unknown or other
  misc_feature (454)..(454): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaaattcgacccagtcctccatcctccctgtctgcatctattggagacagagtcacctatcacttggccgggacgagtcaggccatcagcgtatttctttacgccgttggttcgctagcaacgaaaccgaggggccgacgcccctnacgtcgtacgtagtctagtggtnctatccagtatgacgtaagggtcgggtacccagtccgtacggttcaggtggcgtagtgcagtcgtagggacagtattacactcgtactaactntacacgctacgcctgacgtacgtcgtaggaaacgtttntttagactttaatttaccgtatacgtactaactaagttacttaactaccgttaacccgtggtacggaccgtttcggaccgggaagggtaccgaagggtaggtaacgtaccgaacgtcggtagcgtacctaggtaccc

SEQ ID NO: 216394 - DNA, 401 bp, Homo sapiens
  misc_feature: GYAE6OF02I1YGF.1.34.D01.1.454.CMB.1.raw
  modified_base (316)..(316): a, c, t, g, unknown or other
  misc_feature (316)..(316): n is a, c, g, or t
  modified_base (384)..(384): a, c, t, g, unknown or other
  misc_feature (384)..(384): n is a, c, g, or t
  modified_base (390)..(401): a, c, t, g, unknown or other
  misc_feature (390)..(401): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtgggtcccatccaggttcagtggcagtgcatctgggacagattacactctcactatcagcagcctgcagcctgaagtattttgctaattttattactgtacaacagttatatacgtaccccctagtggacgttcggccaggggaccaaggtggaagtcaacgaactgnggctgcacatctgtcttcatccttcccgccttcctcacgcactcgtctgacgcgggctggacaaggcncatagnnnnnnnnnnnn

SEQ ID NO: 216395 - DNA, 799 bp, Homo sapiens
  misc_feature: GYAE6OF02JM170.1.34.D01.1.454.CMB.1.raw
  modified_base (488)..(488): a, c, t, g, unknown or other
  misc_feature (488)..(488): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgctatctagttggagacagagtcaccatcacttggccgggcagtcgaggccagtcagcgtatttcttagccgttggttgacagacgaacgaaaccgagggacgaacgccccgtagagtacgtacggttagtcctaagttgggacgtacctaactaccgtaagtagttacggaccggtaacggggttaccggggttaccccaacgtttccggtaacggttttacgaacgggttggaccggtaagtcgaccgtaagtcggtacggggaactagtacgttaaccaccttaccgtaactaccgtttanaaccggtaacgtccgtaacgtcccgtagtacccgtacggttacccgtaagtaaaccggtttactttacgggtaacctttaaagtttttaaccgtttaccgttaaggttaaccccgttaaacgtttagggttttaaaccttttaaacgttaaccccgggttaaaccccgtttaacgggttaacccgggtttaaccggtttacccggggtaaacccgggtaacggggtaaccgggttaaaccgggttaacggtaaccggttaaccccgttaaccggtaaggttaccgtacggggttccttaaccggtaacccg

SEQ ID NO: 216396 - DNA, 609 bp, Homo sapiens
  misc_feature: GYAE6OF02IUI4W.1.34.D01.1.454.CMB.1.raw
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
  modified_base (478)..(478): a, c, t, g, unknown or other
  misc_feature (478)..(478): n is a, c, g, or t
  modified_base (602)..(602): a, c, t, g, unknown or other
  misc_feature (602)..(602): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctagttggagacagagtcaccatcacgttggccgggcgagtcgaggccatcagcgtattctttacgccgttggttcgcagcaacgaaaccgagggccggaacgccccgtagacgtacgttcgtaagtctagtcgggtacacacgtccgagtagttacgacggtaacggggtcggtcccaagttccgtaggttccaggtcggacgtagtcgacgtgttacggtagggaactagtacttaacnctacgtacacttancgagcgactccgtagcgacgtacgttagaaagtttntttagaactttaatttactcgtacgtaactaacttagttaactacgttaaccgtacccgttaggtcgtacggttcggacggtaacggacgtaaggtcgaacgtaccaacgtacgtggcggtacngtaaccg

SEQ ID NO: 216397 - DNA, 660 bp, Homo sapiens
  misc_feature: GYAE6OF02JJ34K.1.34.D01.1.454.CMB.1.raw
  modified_base (223)..(223): a, c, t, g, unknown or other
  misc_feature (223)..(223): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttggccgggnagtcaggccatcagcgattctttagcctggttgcagcagaaaccgaggggaccgacgccccgtcacgatcgtagtcctagtcggtgcatcccagtacgttgacgtaagggtcggggtaccccagtccgaggtttcaggtggcgagttcgcacgttcgtaggggacaggtactttaacnccgttactaccgaacttacgtacacgaccacggtccctggaccgtacgcccgttaggaaagttagtttttcgacctttaaattttacgttaacttacggttacctaacgttaagtttaactttaaacgttaaccgttaccccgttaacggttggtaacccggttccgggtaacccggtaacggggtaaccgttaaaggggtacgggtaaaccgttaccgtaacccgggtaaaccgttggtacggtacgttccgaacccg

SEQ ID NO: 216398 - DNA, 543 bp, Homo sapiens
  misc_feature: GYAE6OF02IMXHN.1.34.D01.1.454.CMB.1.raw
  modified_base (281)..(281): a, c, t, g, unknown or other
  misc_feature (281)..(281): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggacatcagcgtattctttagcctggttgcagcagaaaccagggcgagcccctnagatcgtagtctatggtgcatccaagtattgacaagggtcgggtcccatccgaggttcagtggcagtgcatcgtgggactagtacttacactctacactatcagcagcctgcagcctagaatntttgacttaatttattactcgtactaactagttaattaactaccgtaaccccttaggtacggtaccgttcgggaccgtaaggggacctaaagggtcggaaacgttccgaaaccggtagttcggtacggtcctaggaccc

SEQ ID NO: 216399 - DNA, 531 bp, Homo sapiens
  misc_feature: GYAE6OF02FIGFV.1.34.D01.1.454.CMB.1.raw
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcgaagggtcgggtcccagtccaggttcaggtggcagtgcatcgtgggacagtattacactctcactatcagcagcctgcagcctagaagtattttggacttaaatttattactgttactaactagttaattactacgtaccccttagtcggtacgttcggaccgaacggggacctaagggtacggaacgtaccgaaacccggtacgtggtcggcctgtaccc

SEQ ID NO: 216400 - DNA, 597 bp, Homo sapiens
  misc_feature: GYAE6OF02IT069.1.34.D01.1.454.CMB.1.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (407)..(407): a, c, t, g, unknown or other
  misc_feature (407)..(407): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgtattctttagccttggttcgcagcaagaaaccgagggcacgcccctnagatcgtagtctagtggtgcatccagtatgacgaagggtcgggtcccagtccaggttcaggtcggcagtgacagtcgtgggacagtacttacacgttactactactactcagaccagtccngcacgtcagtaagtactttagacttaaattttcgtaactcgtaacctaaacgtagtttaattaacgttaaccgttaccccgtaggttacccgggtacggtttacccgggaccgtaacgggggaaccctaagggttacggtaacgttaccggaaaccggtaagttcgggtacggtacccgtaggtaacccc

SEQ ID NO: 216401 - DNA, 540 bp, Homo sapiens
  misc_feature: GYAE6OF02GL3EW.1.34.D01.1.454.CMB.1.raw
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaaccagggcgacgcccctnagatcgtagtctagtggtgcatccagattgcgaagggtcgggcccagtccgtaggttcaggtggactaggtgctagtcgtagggacagtacttacnctcnctactatcagcagccctgcacgtcctagtacgttatttagacttaatttattactgtaccaatagttaattagtaccgttaccctaggtacggtacgttccgggaccggagggaccgtaaggtacggaacgtaccgaaccggtagttggcgtctgtacc

SEQ ID NO: 216402 - DNA, 636 bp, Homo sapiens
  misc_feature: GYAE6OF02HRIGQ.1.34.D01.1.454.CMB.1.raw
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaagaaaccngggcgacgcccctcagactcgtagtctagtggtncatccgagtattgacgaagggtcggtacccagtccgaggttcaggtcggacagtgcagtcgtagggacagtactacactctacactatcacgcacgcctagctacgccgttagaaacgttnttttacgactttaaagttttacttacgtacgtaactaaacgttaagttaacgtttaaactaaccggtttaaccccgttaacgggttacgggttaacccgggttttaccgggaacccgggttaacgggggtaacccgtaaaggggtttaccggaaacggttacccgtaaaccgggtaaccgttcggggttaacggtacccgttagtaaccccg

SEQ ID NO: 216403 - DNA, 767 bp, Homo sapiens
  misc_feature: GYAE6OF02IDCSH.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctctgggctcctgctgctctggctcccaggtaccagctgtgacatccaattcgacccagtcctccactccctcctgtctgcattctattggacgacagacgtcaccagtcacgttcggccgggtacgacgtcgacgggcctaagtcgaaggcgtacgtttctttaacggccgttgggtttgccgtaaggccaaacggtaaaccgaggggaacccgaagccccctagaacgtacgttacggtaagttacttaaggtcgggtacgtaccgaacttacccgtaaggttactttcgggtacggtaaacgggggttccgggttaccccgtaagtttaccccgaaggggtttaccaacgggtttacgggaacgtacggttcgacggtacttcggtaagggaaccttaaagtacgttacccgtacctaccgttaacaccttaattccaaacggtcgaaccgtccgttagaccgtacgtaacctggtaaagtttactttagaacttttaattttaacgttctaacgttaactaacgttaagtttatttaccgaacgttaccccggttagtacgggtaccgtttaacgggccgggtaaacgggtaccggtaaacggggttaccgaacggttaaccggaaccgtaggttacggtacgtaccgtctaacccg

SEQ ID NO: 216404 - DNA, 631 bp, Homo sapiens
  misc_feature: GYAE6OF02GS2NJ.1.34.D01.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattgganacagagtcaccatcacttgccgggcgagtcaggccatcagcgtattcttagcctggttncagcaagaaaccngggcacgcccctgagactcgtagtctagtggtgcatcagtattggacgaagggttcgggtaccagttccgtaaggttcgaggttcgggacgtaggtcgacgtagttcggtagggaacaggtaacttaccacttctactactactcacgcaacgtcctggccaagccgttaagtaacttagttttacgaactttaaattttacttacgttcgtaactaaacgttagtttaacttaaacgttaacccgttaacccgttacggttacgggtaacccggttcgggaaccggtaacgggggtaaccctaagggttacggaaacgttacccggaacggttaacggtcggttacggactcggtaaccc

SEQ ID NO: 216405 - DNA, 686 bp, Homo sapiens
  misc_feature: GYAE6OF02I77XM.1.34.D01.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (371)..(371): a, c, t, g, unknown or other
  misc_feature (371)..(371): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctccaggtaccagctgtgacatccaattgacccagtctccatcctccctgtctgcatctattgganacagagtcaccatcacttgccggngagtcaggccatcagcgattcttagcctggttgcagcagaaaccgaggcgacgcccctacagagtcgtagtctatcggtgcatccagtattacgcgaaggttcggggaccctagtccgaaggtttccgaaggtcggacagtgaccagttcgnggggactaggtacttacaaccgtcttacacttagtacgaagcgacgtccctggacctaggtacccttaggtaaacgttactttttacggaacctttaaactttttaacgtttaaccgttacggtttaaccaaaccgttacgtttaaatttaaacgtttaaacccggttaaccccgttaaccgggtttacggtaacccggttttaccgggtaaccccgggtaaaggggtacccgtaaaacggggttacgggttaaacggtaacccgttaaacccgggttaacgttaaccggtccggttaccgtacggttaaccccg

SEQ ID NO: 216406 - DNA, 631 bp, Homo sapiens
  misc_feature: GYAE6OF02ICRMA.1.34.D01.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctatgganacagngtcaccatccacttgccgggcgagtcaggcatcagcgattctttagcctggttgcagcaagaaccagggacgacgccccncagagtccgtagtctagtggtgactactccaagagttcgacgaacgggttggggtccccagtccgtaggttcaggttgacgagtgcatcgagggtacagtagttaacactacctacacttatcacgacacggtcctacggacacgccgttagtaaacgttatttttacggaacgtaaactttttaagttaccgttgtaactaaacgttacgttaaatttaacgtaaccgttaacccgtttacggtacggttaccggtttacgggacccggtaaacggggttaacccgaaacggggtttaacgaacgttaccggaaccggtaaccgttacggacggtaccgtggtaacccg

SEQ ID NO: 216407 - DNA, 708 bp, Homo sapiens
  misc_feature: GYAE6OF02I37XG.1.34.D01.1.454.CMB.1.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatggagacagagtcaccatcacttgccgggcagtcaggccatcagtcattcttagccttggttcncagacacgaaaccgngggccacgcccctanagacgttacgtagtactagtcggtgctatccgaagtattcggccgtaaaggggtcgggtacccctaagttcccgagggtttaccgaagggttcgggctaacggttcggacttaacgttccggtaggggacctaggtaactttaccgacttactaccgtaacgtatacgagtaccgacgtcccgtagaccgtacgtacgttaaggaacgtttcgttttacggtactttaaaaggtttttacttaacccgtttacgttaaccgtaaacgtttaagtttaaaccttaaaccgttaacccggttaaccccgtttaagggttaccgggtaaccggttttacccgggaaccggtaaccggggaaccggttaacggggtacggtaaaccgttaccgaacccggttaagtcggtacggacccttacgaaccg

SEQ ID NO: 216408 - DNA, 591 bp, Homo sapiens
  misc_feature: GYAE6OF02G7ZIX.1.34.D01.1.454.CMB.1.raw
  modified_base (387)..(387): a, c, t, g, unknown or other
  misc_feature (387)..(387): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaagggtcggggtcccatccgaggttcaggtggcagtcgcatcgtggggaaccaggacttacgacttctacgtaactatcagcagcctgcagcctgaacgtntttgacttaatttacgttactacgtacaaactacgttaattaacgtaacgttaccccttaggtacggtacccgttcgggaccgtacggggaaccgtaaagggtacgggtaaactaccgaaccggtaacgttggtacgggtactcggaccaacccgtattacccgttcgttacccgttacgtaacgtttcccgttcccgtaaccc

SEQ ID NO: 216409 - DNA, 617 bp, Homo sapiens
  misc_feature: GYAE6OF02J0IXL.1.34.D01.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagacgagtgcgtcacgaccggtgctcgatttagatcgtctgtgttgggtttggggagtcagaccctgtcaggacacagcatggaccatgagggtcccgctcagctcctgggctcctgctgctctggctcccaggtaccagctgtgacatccaattgacccagtctcatcctccctgtctagcatctatgganacagngtcacntcactgccgggnagtcagcatcagcgtattcttagctggtgcagcaagaaccagggcacgccctacagaactcgtagtcctagtcgggtcncagtacctagtagttgacgtaaagggtcgggtaacccngtccgtaggttcaggtcgctaagtgctacgttggngggaatcggtaactacgtactcgttacaacgtattcgaaacggtcaacgccctagaccgganaacccggttnaaaggtatttttaacggctttaaaacggtttatttacggacttaaccgtaacttggttaaactttacgtaacccgtttaacccgtaggtaccgttacggttacggaccgggttaacggaacgtaaacggtacggaactttacggaaaccgttccggtaagttcggacctaacgccg

SEQ ID NO: 216410 - DNA, 764 bp, Homo sapiens
  misc_feature: GYAE6OF02I9X61.1.34.D01.1.454.CMB.1.raw
  modified_base (315)..(315): a, c, t, g, unknown or other
  misc_feature (315)..(315): n is a, c, g, or t
tcagacgagtgcgtcacgaccggtgctcgatttagatcgtctgtgttggggtttgggggagtcagaccctgtcaggacacagcatggacatgagggtccccgctcagctcctgggctcctgctgctctggctcccaggtaccagctgtgacatccaattgacccagtctccatccctccctgtctgcatctattggagacagagtcaccatcacttcggccgggcgagtccgaggcccatcagctattcttagcctggttgcagacaagaaaccgaggacgacgcccctagacgtacttcgtacgtctagtggtnacaactccagtatacggacgtaaggggttccgggtacccaagttacccgtacgggtttacaagggtcggaccgtaggttcgtacgtacgtttccgggacggggtaaacctacggtaactttaacccgtacccgtttacccgttaacctaaccttaacgttccgtaaaccggtcccgaaccggtcccgtacggtaccgtaacggttacccgtttaagggtaacgttttaaagtttttccgaaacgttttaaactttaactttaacgtaccggtttaacctaaacggttaaccgttttaaacttaccgttttaaacccggtaaccccgtttagggtaccggtttaccgggttacccgggaacccggggtaaaccgggtaaaccgggtaagggttaaccgggaaacgttaccggtaacccggtaggtcggtacggtaccggtacgtaacccg

SEQ ID NO: 216411 - DNA, 543 bp, Homo sapiens
  misc_feature: GYAE6OF02HKXAO.1.34.D01.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgctatctatgganacagagtcaccatcacttgccgggcagtcaggccatcagcgattcttagcctggttgcagcaagaaaccagggcacgcccctanagactcgtagtctatggtgcatccagtattgctaagggtcgggtacccatcctaggttcagtggcagtgacatcgtgggacagtactacactctacactatcagcacgcctgctagcctagaacgtatttacgactaaattttactactcgtacaacttaagttacttaacgtaaccgttaccgtacgtacggtacgttcgggaacgtacgggaacgtaacgggtagtaacgtacgaaccgaagttggtcgtactagtaccg

SEQ ID NO: 216412 - DNA, 616 bp, Homo sapiens
  misc_feature: GYAE6OF02F7JJZ.1.34.D01.1.454.CMB.1.raw
  modified_base (267)..(267): a, c, t, g, unknown or other
  misc_feature (267)..(267): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggcagtcaggccatcagctattctttagcctggttgcagcaagaaaccngggccgacgcccctgagagtcgtagtctagtggtcgcactccaagtattcgacgtaacgggtcggtcccagttccgaggtttcaggtggcagtncgagtcgngggacagtacttacactctactactatcgacncgacgccgtagcaacgccgtagtaacgttnttttgactttaaatttactttacgtagttactaaacgttagtttaacttaacgttaccgttaaccccgttacggttacgggtaaccggtttcgggaacccgggtaacggggtaacccgtaaggggttacggaaacggttacccgaaacccggtaacgttacgggtccggtacgttacggaacccg

SEQ ID NO: 216413 - DNA, 656 bp, Homo sapiens
  misc_feature: GYAE6OF02GW20M.1.34.D01.1.454.CMB.1.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagatcaccatcactggccgggcagtcaggccatcagcgtattcttagccttggttncgagcaagaaaccgngggcgaaccgcccctagacgatcgtagtctagtggtgcatccagtacttggacgaaggggttcgggtacccaacgttcgaggttcaggtggctaaggtcgacgtagttcgtacggggaactaggtaacttaaccgaccttctactaacgttaatccgaacgacgaaccgtccgttacgacgtaaccggtccttaaggaaatttactttttaacggaccttaaagtttttaactacgttacgtaacctaaacgttatttaactttaaacggtaacccgttaaccccgttaagttccgggtaaccggttcggtaaccgggaacgggtaaccgtaagggtacggtaaacgtaccgtaaccggtaacgtccgggttagtaccgtagacccg

SEQ ID NO: 216414 - DNA, 525 bp, Homo sapiens
  misc_feature: GYAE6OF02ION00.1.34.D01.1.454.CMB.1.raw
  modified_base (197)..(197): a, c, t, g, unknown or other
  misc_feature (197)..(197): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttgccgggcagtcaggccatcagcgattctttagcctggttgcagcaagaaaccaggggcagcccctcagactcgtagtctatggtgcatccagattgactaaggtcgggtcccagtccgaggttcaggtggcagtgcatcgtagggacagtattacactctacactatcagcacgcctgcacgctagaatntttnacttaatttatactntacaactagttattatacgtaccctaggtcgtacgttcggaccgtaaggggacctaagggtacgaacgttaccgaaaccggtacgtggtacggcctgaacc

SEQ ID NO: 216415 - DNA, 634 bp, Homo sapiens
  misc_feature: GYAE6OF02JA2CL.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcattctattggagacagagtcacatcacgttgccgggcgagtcaggccatcagcgtatttcttagccgtggttcgcgagacacgaaaccgagggcgacgcccctcgacgactcgtaggtcctagtgggtcgctacgtccagatttcgacgtacgggtcgggtcccacgttaccgtaggttcgaggtcgggtactaggtcgtactacgtcggttacggggacaacgtacttaaccgtccttacgtctaactacgtacgacgtcaccgctcggtccagtcctaaggtacgttatttacggactttactttaacttcgtacgtacctaactagtttaacgttactaaaccgttaccccgttagggttacgtaccggtccggtaacgtacgggtaaccgtaaggttacggtaacggtaccaaccgggttctagggtacggtacctggtaaccc

SEQ ID NO: 216416 - DNA, 731 bp, Homo sapiens
  misc_feature: GYAE6OF02JIRFN.1.34.D01.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (290)..(290): a, c, t, g, unknown or other
  misc_feature (290)..(290): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatgganacagatcaccatcacttggccgggnacgtcaggccatcagcgtattcttagccttggttgcagacaacgaaaccgcgggaccgaaccgcccctanacgacgtcgttacgtctagtggtcgctacgtccgtaagtacgttacggacggtaacgggttccgggtaccctacggttaccgtaaggtttacgacggttacggtaccgtaaggttacgtaccgtacgttaccggtaggggaacctaacgggttactttacctaaccgttcgtaacctacgttaactccgaagccgaacgtcccgtggacctacggtacgtacggtaaacgtttacgttttacgaacgtttaaatttttacgttaaccgttacgtaaaccgttaaacgttaacgttttaacgtttaaacgttaaccggtttaaccccggttaacggttacggttaccgggttaccggtaaccgggaaacgggttaaccggtaaagggttacggtaaccgttaacgtaaccggttagtacggtacggttacgtaccgtaaccg

SEQ ID NO: 216417 - DNA, 572 bp, Homo sapiens
  misc_feature: GYAE6OF02FJWAS.1.34.D01.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (367)..(367): a, c, t, g, unknown or other
  misc_feature (367)..(367): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttggccgggcgagtcaggccatcagcgattcttagcctggttncagcagaaaccngggcgagcccctnacgatcgtagtctatggtgcatccagtattgcgaaggtcgggtcccatccaggttcagtcggcagtgcatcgtgggacagtattacnctctcactatcagcagcctgctacgcctagaacgtattttacgacttaaattttacttacttgttaaccaacgttagttaacttaacgtaccgttaaccccgttaggtcgggtaaccgttccgggacccgaagggggtaaccctaaagggttacggtaacgtaccgtaaacccggtaacgttaggtcggtacgttacgtaacccg

SEQ ID NO: 216418 - DNA, 519 bp, Homo sapiens
  misc_feature: GYAE6OF02FT6YR.1.34.D01.1.454.CMB.1.raw
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgacgcccctcagatcgtagtctatggtgcatccagattgcaaggtcgggtcccatccaggttcagtcggnagtncatcgtgggacagattacactctcactatcagcagcctgcagcctagaagtattttgacttaatttagttactagtacaactagttattaattacgtacccttaggtggacgttcgggcgaacgggacctaagggtacggtaagtaccgaaccgtaacgtggtcgtactgaccg

SEQ ID NO: 216419 - DNA, 554 bp, Homo sapiens
  misc_feature: GYAE6OF02IL688.1.34.D01.1.454.CMB.1.raw
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcgagtcaggccatcagcgtattctttacgccttggttgcagcaagaaaccgagggcgacgcccctnagatcgtagtctatggtncatccagtattgacgtagggtcgggtcccagtccgaggtttcgaggtggctaggtgcagtcgtagggactaggacttacactctacactancagcagcctgaccagcctagtaagtatttagacttaatttacttactgtactaactagttaattactaaccgtaccctaggtacggtaccgttccgggaccgtacgggaccgtaagggtacgaacgtaccgtaaccggacgttggtacgtcgtacgacc

SEQ ID NO: 216420 - DNA, 576 bp, Homo sapiens
  misc_feature: GYAE6OF02HR97S.1.34.D01.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (307)..(307): a, c, t, g, unknown or other
  misc_feature (307)..(307): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatccctccctgtctgcatctattggancagagtcaccatcacttggccgggcagtcaggccatcagcgtattcttagcctggttncagacagaaaccgagggaccgacgcccctgagtatcgtagtctagtggtncatcagtattgacgaaggggtcgggtacccagtccgtaggttcgaggtggcgagtgacatccgagggactagtactttacctacctctcgaacttactcagtaccagtccgtgacacggtcctagtaagttattttagacttaatttactacgtctacaacgtatttaacttactaaccgttaccctaggtaccggttacgtccggacggtacggggtaacgaaggtacggaacgtaccgtaacgtacgtggtaacgggtctagtaccc

SEQ ID NO: 216421 - DNA, 587 bp, Homo sapiens
  misc_feature: GYAE6OF02GKA8N.1.34.D01.1.454.CMB.1.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattctttagcctggttgcagcagaaaccaggcgagcccctnagatcgtagtctatggtgcatccagattgcgaaggtgggtcccagtccaggtttcaggtggcagtgacatcgtagggacagtattacgactctcactatcgagtcagcctgcacgcctagaagttattttaggacctaaattttacttaactgttaccaactaagttaatttaacgtaacgttaacccctaggttacgtaccgggtttccggaccggtaaccggggtaaccgtaaacggggttacggaaacggtttaacccgaaacccggttaaaccggttcggtttacgggccgttacgtaacccgg

SEQ ID NO: 216422 - DNA, 584 bp, Homo sapiens
  misc_feature: GYAE6OF02IH9CD.1.34.D01.1.454.CMB.1.raw
  modified_base (277)..(277): a, c, t, g, unknown or other
  misc_feature (277)..(277): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
tcagacgagtgcgtcacgaccggtgctcgatttagatcgtctgtggttgggtttgggggagtcagaccctgtcaggacacagcatggacatgagggtccccgctcagctcctggggctcctgctgcgtctggctcccaggtaccagctgtgacatccaattcgacccagtctccatcctcctgtctgcatctattggagacagagtcaccatcacttgccgggcagtcaggcatcagcgattcttagctggttgcagcagaaacagggcagcccctnagactcgtaatctaatggtcgctatccaaggattggacgtaaaggggtgggtaccccagtcccgaagggtttcaaggtcgggacaggtgactagtccgtaggggactagtaattacactctacaactatcaagcagctgcagctagaaatntttgactaaattttatacgtcgtanaactagttaattaactaccgtaaccccgttaggtaggtaacccgtttcgggaaccctaagggggaacccgtaaagggttacggaaacgttcccgaaaaccggtaacgttcggtacgggtccttaggacccg

SEQ ID NO: 216423 - DNA, 712 bp, Homo sapiens
  misc_feature: GYAE6OF02G6474.1.34.D01.1.454.CMB.1.raw
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgcatctattggagacagagtcaccatcacgttcggccgggcgagtcacggccatcgagcgtatttcgtttagccgttggttgcagaccgaaggaaaccgaggggacaccgtcccctanagacgttcgtaagtctagtggtcgactacgtaccgagtagttcggacggtaaggggttcgggtacccagtccgtagggttacgaggtggactaggtcgactagtcggtagggactagtaacttaaccacctttctactaacttatacgagaccacgtcccgtaggacccgtaacggtaccgttaaggtaaacgtttacgtttttacgaacgttttaaactttttaccgtttaacgttacgttaacctaaacgttaaacgttttaacttaaacggttaacccgttaaccccgttagggttaccgggtaccggtttacccggggaaccgggtaacggggtaaccgtaaaggggttaccggtaaacgtacccggtaaaccggttacgtcggtacgggtaccttacggaaccc

SEQ ID NO: 216424 - DNA, 645 bp, Homo sapiens
  misc_feature: GYAE6OF02JAH6L.1.34.D01.1.454.CMB.1.raw
  modified_base (327)..(327): a, c, t, g, unknown or other
  misc_feature (327)..(327): n is a, c, g, or t
tcagacgagtgcgtcacgaccggtgctcgatttagatcgtctgtgttgggtttgggggagtcagaccctgtcaggacacagcatggacatgagggtccccgatcagctcctggggctcctgctgctctggctcccaggtaccagctgtgacatccaattgacccagtcctccatccctcctgtctgcatctattggagacagagtccacatcacgttcggccgggcgacgtcgacggaccagtcagtcgtatttcgttacgcgttggttgacagacaacgaaacgagggaccgacgcccctcgacgtagtccgtagtctagtggtcncatccagtagtagtacgaaggggtccggtacctagtccgtaggttacgaggtgacgtagtgtactagtcggtacgggactaagtacctttacgactttacctacgactttaacgcgacggtactacggcctaggacctaccgtacctaggtaacttttacgtttacgaacctttaagtttttactacgtacgtaaccttaagttaagttactttaaagtacccttacccggtagtcggtaaccgtccggtaaccgggtaagggtaacccggtaaggtacggaagttaacccgaacgtcggttggacgtcgtaccgtac

SEQ ID NO: 216425 - DNA, 673 bp, Homo sapiens
  misc_feature: GYAE6OF02FRTYD.1.34.D01.1.454.CMB.1.raw
  modified_base (213)..(213): a, c, t, g, unknown or other
  misc_feature (213)..(213): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttggggttttggggggaagtcgagaccctgtcgaggacacagcagtcggacgatgacgggtccccgctacgagcttcctggggctctgctgctcgtggctccaggtaccagctggtgacatccaattcgacccagtcctccatccctccctgtctgcatctattgganacagagtcaccatcacttggccgggcagtcaggccatcagcgattctttagcctggttgcagcaagaaaccgngggcgacgcccctanagattcgtagtctagtggtcgcatccagtagttgcgtaagggtcgggtcccatccgtaggttcaggtggtcgagtcgctagtcggtggaacagtacttacacgttacnctaactatacagactaccggtctcgacgacgccttaagtaacgtttacttttagacctttaaagttttacttacgttacgtacctaaacgttagttaactttaacgttaacccgttaaccccggttacggttacgggttaacccggttaccggaacccggggttaaaccgggggaaccccgggtaaacgggttaacggtaaacccgggtaccggtaaaacccggttaccgggttaagggtacgggtaccggttacgaaccccgg

SEQ ID NO: 216426 - DNA, 391 bp, Homo sapiens
  misc_feature: GYAE6OF02HCR5H.1.34.D01.1.454.CMB.1.raw
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (383)..(391): a, c, t, g, unknown or other
  misc_feature (383)..(391): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaattttattactgtacaactagtattatacgtacccctagtggacgttcgccgaggggaccaaggtgaagtcaacgactgtgctgcacatctgtctcatcctccgcctcncncgcactctcngcgcggctggacaggcgacagtacgnnnnnnnnn

SEQ ID NO: 216427 - DNA, 633 bp, Homo sapiens
  misc_feature: GYAE6OF02JZM27.1.34.D01.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtaccagctgtgacatccaattgacccagtctccatcctccctgtctgcatctattgganacagagtcaccatcacttgccgggcagtcaggccatcagcgattcttagcctggttncagtcagaaaccgngggacgacgcccctcacgactcggtatctagtggtcncatccgtagattcggacgtaagggtcgggtaccccagtcctaggttacacggtacggtcaaggtcgacgagttcgcgggtaacacggtacttacgacttctactaactagtacgaacgcacggtaccttcgactacgtaccgtagaaagttcttttacggacgtttaaacttttaacgtactttacggtacctaaacgttaattaacgtttactaaccggttacccttgggtacggttaccgttaccgggaacggtaaccggttaacgtaacgggttaggtaaacggtaccgtaaccggtaacgtttacgggtcgggtactcggtaaccg

SEQ ID NO: 216428 - DNA, 608 bp, Homo sapiens
  misc_feature: GYAE6OF02IWR2Y.1.34.D01.1.454.CMB.1.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (391)..(391): a, c, t, g, unknown or other
  misc_feature (391)..(391): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagccttggtncagcagaaaccagggcgacgcccctnagatcgtagtctagtggtncatccgagtattcggacaagggtcgggtccagtccgaggttcaggtggacagtcgcatcgtgggacagtattacactctacactatcagcacgtcctgacacgacctgtaacgtntttagacttaatttacgttactgtaacaaactagtttaacttaagttaccgtaacccgttacggttaggtaccgtttcgggaccgtaacggggtaaccgtaggttaacggaacgtaccgaacggtaacgttgggtacggtaccgtcggtaaccgtacctacgtttaccgttcggtttacccttactaacccgttttaccccttaccccgtacccccg

SEQ ID NO: 216429 - DNA, 548 bp, Homo sapiens
  misc_feature: GYAE6OF02GFU17.1.34.D01.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (406)..(406): a, c, t, g, unknown or other
  misc_feature (406)..(406): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcagaaaccagggcgacgcccctnagatcgtagtctagtggtgcatccagtattgcgaagggtcgggtacccatccgaggttcaggtggcagtgcatcgtagggacagtattacactctcactatcagcacgcctgcagcctagaagtnttttagacttaaatttacttacgtgtacaacgttagttaattaacgtaccgttacccgttaggtacggtaccggttaccgggacgaacggggtaaccgtaagggtacggtaacgtaccgaaccgtacgtggtcggtctgacc

SEQ ID NO: 216430 - DNA, 674 bp, Homo sapiens
  misc_feature: GYAE6OF02HNP7P.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagcctggttcgcgagcaagaaaccgagggcgacgcccctgagtactcgtagtctagtggtgcatccagtacgttgcgtaaggggtccgggtaccccagtcccgtaggttccgaaggtcggtacgtagtcgactacgtcgtagggacaaggtattaacctaccgttactacaacttactcgtaacgccgtaacggtccctagaccgtaccgtaccgttaagtaacgttagtttttacgaatttaaagtttttacgttaacgttaggttacctaaacgttaacgtttaacttaaacgttaaacccggtttacccgtacggtttacgggtaccggttaacccgggtaccgggtaacggggtaaccggtaaagggttaccgggtaaacgttaccggaaacccggtacgttcgggtaacgccgtagtaacccc

SEQ ID NO: 216431 - DNA, 593 bp, Homo sapiens
  misc_feature: GYAE6OF02IG22V.1.34.D01.1.454.CMB.1.raw
  modified_base (103)..(103): a, c, t, g, unknown or other
  misc_feature (103)..(103): n is a, c, g, or t
  modified_base (166)..(166): a, c, t, g, unknown or other
  misc_feature (166)..(166): n is a, c, g, or t
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (368)..(368): a, c, t, g, unknown or other
  misc_feature (368)..(368): n is a, c, g, or t
tcagacgagtgcgtcacgaccggtgctcgatttagatcgtctgtgttggggtttgggggagtcagaccctgtcaggacacagcatggacatgagggtccccgntcagctcctggggctcctgctgctctggctcccaggtaccagctgtgacatccaattgacccngtctccatcctcctgtctgcatctattgganacagagtcaccatcacttgccgggcgagtccaggccatcagcgatttcttagccttggttgcagcaagaaaccgngggcgacgcccctgacgatcgtacgtctagtggtgaccatccaagtatcgcgaaggtcggtcccagtccgaggttcagtggactagtcgacatcgngggaacagtaacttactacctctaccacttactcgacgcacgccgtagacagtacctagaacgtttcttttagaacttaattttacctagttacgttaactaacgttattaactttaaccgtaacgtaccccgttaggtacgggtaccgttaccgggacgtaacggggtaaaccgagggttacggtaaacgtacccaacggtactcgggtagtaccgtgtaaccg

SEQ ID NO: 216432 - DNA, 394 bp, Homo sapiens
  misc_feature: GYAE6OF02GFBS4.1.34.D01.1.454.CMB.1.raw
  modified_base (376)..(376): a, c, t, g, unknown or other
  misc_feature (376)..(376): n is a, c, g, or t
  modified_base (381)..(394): a, c, t, g, unknown or other
  misc_feature (381)..(394): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgcaatttattactgtcaacagtattatagtacccctagtggacgttcggccaggggaccaaggtggaagtcaaccgaactgtggctgcaccatctgtcttcatcttcccacctcctcacgcactcgtctgagcggctggcaaggcnatagnnnnnnnnnnnnnn

SEQ ID NO: 216433 - DNA, 501 bp, Homo sapiens
  misc_feature: GYAE6OF02H29ZK.1.34.D01.1.454.CMB.1.raw
  modified_base (284)..(284): a, c, t, g, unknown or other
  misc_feature (284)..(284): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattcttagcctggttgcagcaagaaccgagggcgacgcccctnagatcgtagtctagtggtgcactccagattgactaggggtcgggtcccagtccgaggttcaggtggacagtgcagtcgngggacagattacactctacactatcagcacgcctgcagcctagatatttancttaatttatactntacatatatatacgtacctgtcgacgttcgcgacgggtacaaggtgaacgtacgaacgtagtggtcgctgacc

SEQ ID NO: 216434 - DNA, 554 bp, Homo sapiens
  misc_feature: GYAE6OF02HIRFB.1.34.D01.1.454.CMB.1.raw
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (549)..(549): a, c, t, g, unknown or other
  misc_feature (549)..(549): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagatcacatcacttcgccgggcgagtcacggccatcagcgtattctttagcctggttgcagcaacgaaaccnggganacgcccctcagatcgtacgtntagtggngcactcagtattgacgagggttcgggtccactcctaggttcaggttggctagtcgactagtcgtagggaacagtactacactctnactatcagcactccngtcacgctagtatagttttgacttaagtttattacgtataacaagttattaacttattaaccgtaccctagggtcggtaacggttcggaccggtaaggggaacctaagggtacggtaacgtaccgaaacgaccgttggcggtcgngaccg

SEQ ID NO: 216435 - DNA, 664 bp, Homo sapiens
  misc_feature: GYAE6OF02IK8OG.1.34.D01.1.454.CMB.1.raw
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
tcagacgagtgcgtcacgaccggtgctcgatttagatcgtctgtgttggggtttgggggagtcagaccctgtcaggacacagcatggacatgagggtccccgctcagctccgtggggctcctgctgctctggctcccaggtaccagctgtgacatccaattcgacccagtctccatcctcctgtctgcatctattggagacagacgtcaccatcacgttcggccgggngagtcaggccatcgagcgtattctttagcctggttgcagacaagaaaccgagggaccgacgcccctanaggacttcggtacgtctagtggtagcatccgagattgacgtagggtcggtaccctagtccgtaggttacaggtacggacgtaggtcgactacgtcggtagggactaagtacttacacttccgtactaacgtactacgagtaccacgtccgtacgactaccggtactaaggtaaacgtttgtttacgaactttaaacttttaacgttacgtacgtaactaaacgttaagtttaacgttaaacgttaaccgttaaccccgttaggtacgggttaacccggttccgggaaccggtaacggggtaaaccgtaagggtaacggtaaccgtacccggtaaaccgttaggtcggtaccggtactaccggtaaccc

SEQ ID NO: 216436 - DNA, 618 bp, Homo sapiens
  misc_feature: GYAE6OF02G87ZX.1.34.D01.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (410)..(410): a, c, t, g, unknown or other
  misc_feature (410)..(410): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttggccgggcgagtcaggccatcagcgtattcttagcctggttgcagcaagaaaccgagggcgacgcccctnagatcgtagtctagtggtcgcatccagtattcggacgtaagggtcgggtacccaagtccgaggtttcaaggtggactagtgacctagtcgtagggaacagtacttaccacttctacctaattacncgaactcacggtccctaggacctacgtccgtaggtaaattagtttttacgaactttaaagtttttactacgttagtactaaacgtagttaatttacgtaaccttacccgtaggttacggtaacggttccgggaccggtaaggggtaacctaaggggtacgaacggtacccgtaaaccggtacgttgggtacggtccgtacgtaacccg

SEQ ID NO: 216437 - DNA, 657 bp, Homo sapiens
  misc_feature: GYAE6OF02GUMOQ.1.34.D01.1.454.CMB.1.raw
  modified_base (312)..(312): a, c, t, g, unknown or other
  misc_feature (312)..(312): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacgttcggccgggcgagtcgaggccatcagcgatttcttagccttggtgcagcaagaaaccgagggccgacgcccctacagactcggtagtctagtggtanctactccagtatggcgtaaggtcgggtacccagtaccgtaggtttacgaggtgacgtaggtcgactacgtcggtacgggaactagtacgttaaccctactccgtactaactacgttcgaacgcctaacggttcctacgtaccgacgttacgttaggtaaacggtttatttacggaactttaaattttacttaccgtacgtaacctaaggttattaactttacgtaacccgttaccgttacggttacgtaacggttccggaaccgggtaacgggtaaccggtaaggggtaccgttaaagggacccgtaaccggttaaagtccgggtttacggactaccggtacccg

SEQ ID NO: 216438 - DNA, 674 bp, Homo sapiens
  misc_feature: GYAE6OF02FS92X.1.34.D01.1.454.CMB.1.raw
  modified_base (266)..(266): a, c, t, g, unknown or other
  misc_feature (266)..(266): n is a, c, g, or t
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccagctgtgacatccaattgacccagtctccatcctcctgtctgcatctagttggagacagagtcaccatcacttgccggcgagtcaggccatcagcgattctttagcctggttgcagcaagaaaccnggggcacgcccctcgagactcgtagtcctagtcggtgcactccagtattgacgtaaggggtcggggtaccctagtcccgtaggttcaggtcggacagttcgcctaattccgtagggacaggtacttacgacttccgtactaacgtactacgaacgtcgaaccgtcctagacccgagtcccttaagaaacgtttagttttacgaacctttaaagtttaactttaccgtacgttaacctaaacgtttaagttaaaccgtttaaacttaccggttaacccccgttaggttacgggttacccggttacccgggtaacccggaacggggttaaacccgtaaggggttaaccggtaaaccggttaaccgaaacccggtaacggtttacggtccgggtaccgtacggtaaccccg

SEQ ID NO: 216439 - DNA, 628 bp, Homo sapiens
  misc_feature: GYAE6OF02J0PXL.1.34.D01.1.454.CMB.1.raw
  modified_base (258)..(258): a, c, t, g, unknown or other
  misc_feature (258)..(258): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttcgccgggcgagtcaggccatcaggcgattctttagccttggttgcagcagaaccagggcgacgccctnagatcgtatctagtggtgacataccagtattcggacgtaacgggggttcggggtacccctagtacccggtaggttccgagggttcgggactaaggtcggctaacgttcggtaacgggactaaggttacttaaccgacttacctacgtactatacgagcacgtctacgcgtacgtccgtaagtaacgtttagtttacgaactttaagtttactttaactacgtactaacgttaagttacttacgttaaccgttacccgttaggtcgtaccggttacggacgggtaacggaccgtaggtaagaacgtaccacggtatcggacgtctcgactaccgattcgttactaccgttactaccgttcccttaccgacg

SEQ ID NO: 216440 - DNA, 678 bp, Homo sapiens
  misc_feature: GYAE6OF02JWHSS.1.34.D01.1.454.CMB.1.raw
  modified_base (172)..(172): a, c, t, g, unknown or other
  misc_feature (172)..(172): n is a, c, g, or t
tcagacgagtgcgtcacgaccggtgctcgatttagatcgtctgtgttgggtttgggtcgatggacatgagggtcccgctcagctcctgggctcctgctgctctggctcccaggtaccagctgtgacatccaattgacccagtctccatcctccctgtctgcatctattgganacagagtcaccatcacttgccgggcagtcaggccatcagcgattctttagcctggttgcagacagaaaccgagggcgacgcccctcagaactcgttagtcgtagtggtcgctatcccagtacttggacaaggggttcgggacccagtcccgaaggttcaggtggacagtcgctacgtgttggacgagtactacgtactccgttactaagactcgacgtaccgacgtacccgttgacccacggtccttagggaaatttactttaggcttaaatttacgttactggtaactaaaccgtattaacgttaacttaacgttaccccgtagtttacgggtaccggttacggtaccggtaacggggaacccggtaaagggtaacccgttaagaaccgtaaccccgggtaagttaaccggggtcggtacgttaccggtacccgtaaacccgttattaacccggttcgtttaaacccgtttacgtacccgtttttacccgaccccccgtttaacg

SEQ ID NO: 216441 - DNA, 590 bp, Homo sapiens
  misc_feature: GYAE6OF02H37A0.1.34.D01.1.454.CMB.1.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (344)..(344): a, c, t, g, unknown or other
  misc_feature (344)..(344): n is a, c, g, or t
  modified_base (417)..(417): a, c, t, g, unknown or other
  misc_feature (417)..(417): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatgganacagagtcacatcacttggccgggcgagtcacggcatcagcgattctttagcctggttgcagcagaaccagggcagcccctanacgatcgtatctatggncatccagtattgacgtaaggtcggtcccatctaggttcagtggctagtnacatcgagggacagtaacttacactactcaactactacgacgcaagtcctagccgtacgcttagtaaacgttntttaacggacttaaattttacttacgtagtaacctaacgttattaacgtttaactaaaccgttaccccgttaaggtaccgggttaaccggtttacgggaccgtaacggggtaccgaaggttacggaaacgtacccgtaaaccggacgttacggtacggtaccgtagtaacccg

SEQ ID NO: 216442 - DNA, 591 bp, Homo sapiens
  misc_feature: GYAE6OF02IVUNE.1.34.D01.1.454.CMB.1.raw
  modified_base (141)..(141): a, c, t, g, unknown or other
  misc_feature (141)..(141): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
  modified_base (404)..(404): a, c, t, g, unknown or other
  misc_feature (404)..(404): n is a, c, g, or t
tcagacgagtgcgtcacgaccggtgctcgatttagatcgtctgtgttgggtttggggagtcagaccctgtcaggacacagcatggacatgagggtccccgctcagctcctgggctcctgctgctctggctcccaggtaccngctgtgacatccaattgacccagtctccatcctccctgtctgcatctattgagacngatcaccntcactgccggnagtcaggccatcagcgattcttacgctggtgcagcanaacgaggcgacgcccctcagactcgtagtctagtgtcgactatccagtatagacgaacggtcgggtcccagtccgaggttcgagtcggcgtacgtgactagtccgtgggtacagtagtacctactacgtacacgtatacgtagctagtccnggtacacgtacctagtaactgtttacgacttaagtttattacgtgtaactaacgtaatttacttaactaaccgtttacccgtagtaccgggttaacggttacccggtaacggaacccgggtaacgaaacgggttaccggaaacgtaaccgtaacccgtaaacggttcggtacggtcgtacgtaccgg

SEQ ID NO: 216443 - DNA, 576 bp, Homo sapiens
  misc_feature: GYAE6OF02IFG60.1.34.D01.1.454.CMB.1.raw
  modified_base (287)..(287): a, c, t, g, unknown or other
  misc_feature (287)..(287): n is a, c, g, or t
  modified_base (419)..(419): a, c, t, g, unknown or other
  misc_feature (419)..(419): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgattctttagccttggttgcagcaagaaaccgagggcgagccccctanagatcgtagtctatggtgcatccagtattgacgaagggtcgggtcccagtccgaggttcaggtgcagtgctagtcgtagggacagtattacacctctcaactatcagccagcctgcagtcctagtaacgttnttttacgacttaaattttactacttacgtactaaactagtttaattacgtaaccgttacccgttacgttacggtacggttaccggaccggaaggggaaccctaagggtacggtaaacgtaccgaaccggtaacgtggtacggtaccgtcgtaacccg

SEQ ID NO: 216444 - DNA, 522 bp, Homo sapiens
  misc_feature: GYAE6OF02FZH4M.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagtattgacgaagggtcgggtcccatcccgaggtttcaggtggcagtgcagtcgtagggacaggacttacactctcactatcagcagcctgcagcctgaagtattttagacttaatttattactagttacatagtattactaacgtacccgtacgtggtaccggttcggccggtaagggaccgaaggtcgaagtacgaacgtaacgtgtcggcgtgcc

SEQ ID NO: 216445 - DNA, 575 bp, Homo sapiens
  misc_feature: GYAE6OF02I2UKZ.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttgcagcagaaaccgagggcgacgcccctcagatcgtagtctagtgtgcactccagtattgcgaaggtcggggtcccagtccgaggttacagtcgcgagtcgcagtcgtagggacagtacttacgactctcactatcagcacgctgcacgtccgtagaacgttatttacgaacttaattttacttacgttcgttaacaacgttaagttaacttaacgttaaccgttacccttaggttacggtaccggttccgggaccggaacggggtaaccgtaagggtacggtaacgtaaccgtaaccgtacgtggcggtacgtagtacccg

SEQ ID NO: 216446 - DNA, 753 bp, Homo sapiens
  misc_feature: GYAE6OF02IGD34.1.34.D01.1.454.CMB.1.raw
  modified_base (200)..(200): a, c, t, g, unknown or other
  misc_feature (200)..(200): n is a, c, g, or t
tcagacgagtgcgtcacgaccggtgctcgatttagatcgtctgtgttggggtttgggggagtcagaccctgtcaggacacagcatggacatgagggtccccgctcagctccgtggggctcctgctgctcgtggcctcccgacggtaccagtctgtagacactacctaattcgacccagtcctccacttccctcctcgtcncgctacttctagttggagacagtactccacactacgacgttcgggccgggacgtaagtcgacggccactacgacggacgttacgtttcgttacggtccggttgggttcgaccgacgacgaaacggaaaccggacggggccgaaccgcccctagacgtaacgttcgtacgttactagtcggtacactacgtaccagtacgttcggaacgtaacgggggtaccggtccctaacgtaccggtaggttaccggagggtcggacgtagtcgacgtaacgttcggtaacgggacgaagtacctacgtacttccgaactactagtcgacgacgtacggtccacggtacctacggccgttaaaggtaagttttacgtttacgaactttttaaagttttacgttacgtaacgttaacaaacttaagtttaaaccttaaacggtacccgttacccggttacgggtacggttaccggttccgggaaaccggtacggggtaaccgtaagggttaacgaccctaaccggtaaccgtaacggttggggtactaccggtagtaacccg

SEQ ID NO: 216447 - DNA, 574 bp, Homo sapiens
  misc_feature: GYAE6OF02HHF0G.1.34.D01.1.454.CMB.1.raw
tcagacgagtgcgtcacgaccggtgctcgatttagatcgtctgtgttgggtttgggggagtcagaccctgtcaggacacagcatggacatgagggtcccgctcagctcctgggctcctgctgctctggctcccaggtacctagctgtgacatccaattgacccagtctccatcctccctgtctgcatctattggagacagagtcaccatcacttgaccgggcagtcaggccagtcagcgattctttagcctggttgcagcagaaaccagggcgagcccctcagatcgtagtctatggtgcatccagattgcaaggtcgggtcccatccaggttcagtggcagtgcatctgggacagattacactctcactatcagcagcctgcagccctgaacgtattttgacttaagtttacttacgtgttacaaacgtagttaatttaacgtaacgttaaccccgttaggttacgggtaaccggttttaccgggacccgtaacgggggtacccgtaaagggttacggtaaaggttacccgtaaaccggtaaccgttacgggtacggtaccgttaggaccccg

SEQ ID NO: 216448 - DNA, 569 bp, Homo sapiens
  misc_feature: GYAE6OF02IGVQX.1.34.D01.1.454.CMB.1.raw
  modified_base (292)..(292): a, c, t, g, unknown or other
  misc_feature (292)..(292): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttgcagcaaggaaaccgaggggccgacgccccctanacggtatcggtagtcctagtggtcgcatccagtattgcgaagggtcgggtcccatccgaggttcaggtgctagtgctagtcgtgggacagtacttacacctctacactatcgacgcacgtcctgccagtcctaagtacgttatttagaactttaatttatacctagtacctaacgtattacttacgttaccgtacccgttagtcggtacgttcggaccgacggggacctaagggtacggtaacgtaccgaaccggtacgttggacgtcgtcgacccg

SEQ ID NO: 216449 - DNA, 535 bp, Homo sapiens
  misc_feature: GYAE6OF02HPQUC.1.34.D01.1.454.CMB.1.raw
  modified_base (408)..(408): a, c, t, g, unknown or other
  misc_feature (408)..(408): n is a, c, g, or t
  modified_base (430)..(430): a, c, t, g, unknown or other
  misc_feature (430)..(430): n is a, c, g, or t
tcagacgagtgcgtcacgaccggtgctcgatttagatcgtctgtgttgggtttgggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagccttggttcgcagcaagaaaacccaggggccgacgccccctcgagacgtccgtaggtcctaagtgggtgcactccagtattggacgtaagggtcggggtacccagtccgtaggttccaggtggcagtgcatcgtgggacagtattaacactctacacttancagcagcctgcagcctgaagtnttttagacttaatttacgtactgtacaatagttattatacgtaccctacggtgtacgttcggcggacgggacaaggtcgaagtcaaccgatggcggtctgtaccc

SEQ ID NO: 216450 - DNA, 589 bp, Homo sapiens
  misc_feature: GYAE6OF02HRME5.1.34.D01.1.454.CMB.1.raw
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttggccgggcgagtcaggccatcagcgtattcttagcctggttgcagcaagaaaccgagggcacgcccctnagtatcgtagtctagtggtncatccagtattgacgtaagggtcgggtcccagtccgaggttcgaggtggctagtcgctagtcgtaggggacaggtacttactactctactacttancacgcacgccctgacctagccgttagaagttcgtttagaactttaaattttaacgtacgtagtaactaacgttagttaattaacgtaccgttaacccgttacggttacgggtaccgttacgggaacccggtaaggggaacctaagggtacggtaacgtaccgaacggtacgttgggtacggtcgtgaacc

SEQ ID NO: 216451 - DNA, 641 bp, Homo sapiens
  misc_feature: GYAE6OF02HRCHR.1.34.D01.1.454.CMB.1.raw
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttcggccgggcgagtcaggccatcagcgtattctttagcctggttncagcaagaaccgagggcgacgcccctnagactcggtagtctagtggtncatccagtattgacgtaaggggttcgggtaccccagtccgtaggttcaggttcggcaggtcgacngttcggtgggaacaggtattaccacttctacactatcaacgcacgtcctggccacgccgttaaggaagttcttttaggacttaaattttacttaccgtagttacctaaacgttagtttaacttaaacgttacccgttaaccccgttagggttacgggttaccggtttacccgggacccggtaacgggggtaccgtaaaggggttaaccgggtaaacgtacccgtaaaacccgggtaagtttccgggtaacggttccgtacgtaaccccg

SEQ ID NO: 216452 - DNA, 514 bp, Homo sapiens
  misc_feature: GYAE6OF02HHI4V.1.34.D01.1.454.CMB.1.raw
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (408)..(408): a, c, t, g, unknown or other
  misc_feature (408)..(408): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttncagcagaaccngggcagcccctnagntcgtagtctatggtncatccgagtattgcgaacgggtcgggtcccagtccgtaggttcagtcggcagtcgctagtcgtgggacagacttacactctacactatcgagcacgcctgcagcctagaatntttgacttaatttattactagtacaactagtattactacgtaccctgtcggacgttcggcgagggtaccaagggtcgaagtccgaacggtatggtacggtctgacc

SEQ ID NO: 216453 - DNA, 538 bp, Homo sapiens
  misc_feature: GYAE6OF02GNRPB.1.34.D01.1.454.CMB.1.raw
  modified_base (256)..(256): a, c, t, g, unknown or other
  misc_feature (256)..(256): n is a, c, g, or t
  modified_base (356)..(356): a, c, t, g, unknown or other
  misc_feature (356)..(356): n is a, c, g, or t
tcagacgagtgcgtcacgaccggtgctcgatttagatcgtctgtgttgggtttgggcatggacatgagggtccccgctcagctcctgggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcagcccctnagatcgtagtctatggtgcatccagattgcaaggtgggtcccatccaggttcagtggcagtgcatcgtgggacagattacactctcactatcagcagccngcagcctgaaagtatttagactaaatttagttactgtactaactagttatttaactacgtaaccccttaggtacggtaccggttccggaccgtacggggtaactaaacggggtggaacgttaccgaacgtaacgtggtacggcgttgcctacctatctcgtcttccacttccctcccgtacc

SEQ ID NO: 216454 - DNA, 679 bp, Homo sapiens
  misc_feature: GYAE6OF02JV481.1.34.D01.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagacgagtgcgtcacgaccggtgctcgatttagatcgtctgtgttgggtttgggggtaggtcagaccctgtcaggacacagcatggacatgagggtccccgctcagctcctgggctcctgctgctctggctcccaggtaccagctgtgacatccaattgacccagtctccactcctccctgtctgcatctattgganacagntcacatcacgttgccgggcgacgtcacggccatccgagcgtatttccttagccgttggttcgcacgacgaagaaaccgagggacacgtcccccagacgacgtcgtagtctagtcggtcgacactaccgtagtacttacgcgtaacggggtccggtaccctacgtccggtagttacgtagggtcggaccgtaggtagccgtaacgttcggtacgggacgtaaacggtactttaaccgtaccgttacgtaaccctactaacttacacgggcctaacgcccttagaccgtacgtcgtacgtaacgttacgtttacgtactaatttttacgtattactaccgtaataacgtttattaaacttaccgttaacccgtacgggttacgtacggtttacccgggaacggttaacggtaccggtaacggtaaggtaaccggttacaaaccgggtttagaccggttagtacccggtacgtaaccg

SEQ ID NO: 216455 - DNA, 689 bp, Homo sapiens
  misc_feature: GYAE6OF02HXCTY.1.34.D01.1.454.CMB.1.raw
  modified_base (197)..(197): a, c, t, g, unknown or other
  misc_feature (197)..(197): n is a, c, g, or t
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (363)..(363): a, c, t, g, unknown or other
  misc_feature (363)..(363): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtcctccatcctccctgtctgcatctatgganacagatcaccatcacttgcggcagtcaggccatcagcgattctttagcctggttncagcagaaaccagggccgagcccctanagtatcgtagtctatggtcgcatccagacttgctaagggtcgggtcccagtcccgtaaggttcaaggtggacagtcgcagtcgngggacagtattacgactctcgtactatcacgacacgtccgtagccgtagtcccgtagtaacgttacttttacggactttaaaacgttttacttaaccggttacgttaaccgtaaacgttacgttttaaacctttaaacggttaacccgtttaaccccccgttaagggttacccggggtttaacccgggttttaccgggtaaccccgggttaaaccgggggggtaacccttaaaaggggggttaacccgggttaaaacggttacccggtaaaacccgggtttaaaccggttacgggtttaccgggtaccgttaccggtaaacccccg

SEQ ID NO: 216456 - DNA, 621 bp, Homo sapiens
  misc_feature: GYAE6OF02JQRDM.1.34.D01.1.454.CMB.1.raw
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctatgganacagatcacatcacttgccgggcagtcaggccatcagcattcttagcctggttncagcagaaaccngggtcgagcccctcgagagtaccgtagtcgtatcggtgtcatcccagactttggctaagggtcgggtacccagttccaggttcctaggtggactagtgcagttcgtagggacagtattacgactccgtactactagtacgacgtcaagtccctaggtaccacgtcccgtagtaaagggttacttttacggacttaaattttatttaacgttacgttaacgtaaacttagtttaaactttacttaaacgttaaccccgttagttaggggtacccgttttaccgggacccggttaagggaacccgttaagggtaacggaacgttaccgaaccggaaccgttggtacggtaccgtagtaaccc

SEQ ID NO: 216457 - DNA, 540 bp, Homo sapiens
  misc_feature: GYAE6OF02G6202.1.34.D01.1.454.CMB.1.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (375)..(375): a, c, t, g, unknown or other
  misc_feature (375)..(375): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttgccgggcgagtcaggccatcagcgattctttagcctggttgcagcagaaaccagggcagcccctnagatcgtagtctagtggtgcatccagattgcaaggtcgggtacccagtccaggttcagtggcagtgcatcgtgggactagatacacttctcactancagcacgcctgacacgcctagtaacgtacttttagacttaattttaacgttactagtactaaacgtacgttaattacgtaagttacccctaggtcggtaccgttcggaccgaacggggtactaagggtcggaagtccgaaccggtaactggtacgtctgtacccg

SEQ ID NO: 216458 - DNA, 588 bp, Homo sapiens
  misc_feature: GYAE6OF02FKXAU.1.34.D01.1.454.CMB.1.raw
  modified_base (409)..(409): a, c, t, g, unknown or other
  misc_feature (409)..(409): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttggccgggcgagtcaggccatcgagcgatttctttagcccttggttgcagcaacgaaaccgaggggcacggccccctgagagttcgtagtctagtggtgcatcccaagtattgacgtaagggtcgggtacccatccgaggttcaggtggcaggtcgcgtacgtcgtagggacagtattacacttctactactancagcacgcctgacacgtcctagtaacgttatttcgaacttaacttttattacttacgtactaacgtagttaacttaacttaccgttaccccttaggttcggtacggttacgggaccggaggggaaccctagggttacgaacggttaccgaaccgtagttacggtcggtactccgtaccc

SEQ ID NO: 216459 - DNA, 646 bp, Homo sapiens
  misc_feature: GYAE6OF02JC987.1.34.D01.1.454.CMB.1.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattctttagccttggttncagcaagaaaccgngggcacgccctnagatcgtagtctagtggtnctatccagtattgacgtaagggtcgggtccccagttccgaggttcgaggttcggacaggtcgactattcggtagggaacagtactttaccacgttcctactactatcagtcacgccttgacacgtccgttagaagttctttacggactttaaagtttacgttacgtcgttaacctaaagttacgtttaaagtttaaccgttaaccgttaaccccgtttagggttaccggttaaccggttacccgggaaccgggtaaaccgggggtaaacgttaacggggtaacggtaaaccgttaacccggaaaccggttaacggttcggtacgggtacccttaggtaaccccg

SEQ ID NO: 216460 - DNA, 627 bp, Homo sapiens
  misc_feature: GYAE6OF02IE5X0.1.34.D01.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagatcacatcattgccgggcagtcaggccatcagcgtattcttagcctggttgcagcaagaaaccagggcgacgcccctanagatcgtatctatggtcgactactccagtattcgacgtaaggggtccgggtaccctagtaccgtaacgggtttcaaggttggacgaggtacgtctaacgtcggtacgggacaggtacttacacttactacacttatacgagtacagtccctagaccgtagacccgtagaaacgttatttacgtaacttaaatttacttacgtagttaactaacgttagtttaacttaacgtacccgttaacccgtaggttacgggtaccgttacgggaacccggtaacggggtaccgtaaaagggttacggaacggttaccaaaccggtacggttaggtcggtacgttacgaaccg

SEQ ID NO: 216461 - DNA, 705 bp, Homo sapiens
  misc_feature: GYAE6OF02IINIP.1.34.D01.1.454.CMB.1.raw
  modified_base (321)..(321): a, c, t, g, unknown or other
  misc_feature (321)..(321): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctcctgtctgcatctattggagacagagtcaccatcacttgccgggcgagtcgacggcatcagcgtattacgtttacgccgttggttcgacacgtacaacgaaaccgagggacgacgcccctcgacgtagtacgtagtctagtggtcncactcagtatcggacgtaacggggtcggtacccagtaccgtaggttcgaggtcggacgtaggtacgacgtacgtcggtacgggaactacgttaacttaaccgtaccgttacttaccgtaactacgtacacgtaccgtacgtccgtacgtacctcggtaccgtacgtaagtttactttacggtaactttaacgttttaacgttaccgtacgttaaaccgtaaacgttaacgtttaaattaaccgttaacccgttaacccgggttacggtacgggttaacccggttcgggtaacccgggtaacggggtaaaccggtaaagggtaccggtaaacggttacccgtaaaaccggtacggttacggggtacgtaccggtacggtaacccg

SEQ ID NO: 216462 - DNA, 712 bp, Homo sapiens
  misc_feature: GYAE6OF02HLWUF.1.34.D01.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttacgcctggttgcagcaagaaaccagggccacgcccctnagactcgtagtctatggtgcactccagtattgacgtaaggtcgggtacccagtccgtaggttcaggtcggactaggtcgactagtcggtagggtactaggtactttaccaccgtttcgtacctaacgttacttaccgaacggtaccgaacgtcccgtggacctaacggccgttaaggtaacgtttaagtttttaccggaactttaaacgtttttaacttaccgttacgttaacctaaacgttaacgtttaacgtttaaacttaacccgttaacccccgttaagggtaccgggtttaacccggtttcccggggaaccccgggtaacggggttaaaccccggtaaaggggttaaccggggtaaacccggttaccgtaaaaccccgggttacggtttaccggggttacgggtacccgttacggtaaccccg

SEQ ID NO: 216463 - DNA, 543 bp, Homo sapiens
  misc_feature: GYAE6OF02G4PDW.1.34.D01.1.454.CMB.1.raw
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (538)..(538): a, c, t, g, unknown or other
  misc_feature (538)..(538): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcaagaaaccngggcacgcccctnagactcgtagtctagtggtgcatccgagtattgacgaagggtcgggtcccagtcctaggttcagtggctagtcgcagtcgtgggacagtacttacactctactactatcagcacgctcgcacgtcctagaagttatttagacttaattttactactcgtacaactattattaactaacgttaccccttaggtacggtacgttcggaccggagggtaaccgtaaggtacggacgtaccgaacgtacgtggtcggtcngaccg

SEQ ID NO: 216464 - DNA, 655 bp, Homo sapiens
  misc_feature: GYAE6OF02G1BS9.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccgttggttgcagcaacgaaaccgagggccgacgcccctagacgtactcggtagtctagtggtcgactactccagtagttcgacgtaaggggtcgggtacccacgtccgtacggttctaggtcggacgtaggtcgactagtcggtagggaactaggtaacttaaccgaccttctactaacttactcgacgcaccgtcctagaccgtacgtcctaaggtaagttcttttagaactttaattttacttacgtacgttaactaaacgttagtttaacttaacttaacccgttacccgttacgggttaccggttaccgggttaccggaaccggtaacggggtaacccgtaagggttaacggaaacgttacccgtaaccggtacgttcggtacgggtactaccggtaacc

SEQ ID NO: 216465 - DNA, 614 bp, Homo sapiens
  misc_feature: GYAE6OF02H9X5P.1.34.D01.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgtattctttagccttggttgcagcagaaaccagggcagcccctnagatcgtagtctagtggtgcatccagtatgacgaacgggtcggggtaccccatccgtagggttccaaggtggacgtaggttgctacgtcgtcggggaactagtaactttacaccgttctactaacgttaactacgaggacctacggtacccgttgacctacggtcctaggtaaagttacgttttgaccttaaatttttacgttactacgttactaacgtagttaattacgtaaccgttacccgttagttacggaccgtttcggcggtaacggggtacctaagggtacgtaacgtacgtaacccggtacgttaggttcggctacggtacccg

SEQ ID NO: 216466 - DNA, 463 bp, Homo sapiens
  misc_feature: GYAE6OF02I1645.1.34.D01.1.454.CMB.1.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (393)..(393): a, c, t, g, unknown or other
  misc_feature (393)..(393): n is a, c, g, or t
  modified_base (436)..(463): a, c, t, g, unknown or other
  misc_feature (436)..(463): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaagggtggggtcccatccaggttcagtggcagtgcatcgtgggacagattacactctacactatcagcacgcctgcacgcctagaagtntttgactaatttattactgtaccaanagttattataccgtacccctagtggtaccgttcggacgacggggacctaggtaggaagtaccaaccggaacgtggtacggctacgcactatcgtcgtcttcattcctcccgctatcgagaactcactcgtacgnggtacgggccgggtcgtacgggacgacggtcgacgtagtacgnnnnnnnnnnnnnnnnnnnnnnnnnnnn

SEQ ID NO: 216467 - DNA, 726 bp, Homo sapiens
  misc_feature: GYAE6OF02HX6U7.1.34.D01.1.454.CMB.1.raw
  modified_base (125)..(125): a, c, t, g, unknown or other
  misc_feature (125)..(125): n is a, c, g, or t
  modified_base (259)..(259): a, c, t, g, unknown or other
  misc_feature (259)..(259): n is a, c, g, or t
  modified_base (312)..(312): a, c, t, g, unknown or other
  misc_feature (312)..(312): n is a, c, g, or t
tcagacgagtgcgtcacgaccggtgctcgatttagatcgtctgtgttgggtttgggagtcagaccctgtcaggacacagcatggacatgagggtccccgctcagctcctggggctcctgctgctntggctcccaggtaccagctgtgacatccaattgacccagtctccatccctccctgtctgctatctattggagacagagtcacatcacttggccgggcagtcaggccatcagcgtatttcctttagcctgggttncagcagaaaccgagggccgacgcccctagacgacgtcgtagtctagtcgggtnctactaccagtagttgacgtaagggttcgggtccctagttccgaaggtttcgaaggtggactaggtcgtctacgtacggtagggacaaggtaacttactaaccgtccttacctaacgttaactccgaacgcctaacggtcccgtacggtacgtacggtaccttacggaaacgtttacgttttcgtaaaccttttaagttttaacgttacgttacgttaaaccaaacgtttaggtttaaacttttaacgtaacccggtttaaaccccgttacgggtaccgggttaacccggggtttacccggggtaacgggtaaccgggggtaaacccgggtaaagggtttaccggggtaaaccggttacccggtaaaacccggtacggtttaccgggtaacgggttaccgtacggtaaaccccg

SEQ ID NO: 216468 - DNA, 420 bp, Homo sapiens
  misc_feature: GYAE6OF02G62IR.1.34.D01.1.454.CMB.1.raw
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (407)..(420): a, c, t, g, unknown or other
  misc_feature (407)..(420): n is a, c, g, or t
tcagacgagtgcgtcacgaccggtgctcgatttagatcgtctgtgttgggtttgggagtcaggccatcagcgattctttagccgtggttgcagcagaaacccagggcgacgccccctcagatcgtagtctatggtgcatccagattgcaaggtggggtcccatccaggttcagtggcagtgcatctgggacagattacactctcactatcagcagcctgcagtcctgaagtattttgactaattttattactgtacaactagttattatagtaccccctagtggtaccgttcggcgaggggaccaaggtggaagtcgaaccgagtggtggctgcaccatctgtcttcacttcctcccnccctcctcgacncactcgtacnggtcgcgggctggcgaggctacagtgnnnnnnnnnnnnnn

SEQ ID NO: 216469 - DNA, 839 bp, Homo sapiens
  misc_feature: GYAE6OF02GBA3X.1.34.D01.1.454.CMB.1.raw
  modified_base (204)..(204): a, c, t, g, unknown or other
  misc_feature (204)..(204): n is a, c, g, or t
tcagacgagtgcgtcacgaccggtgctcgatttagatcgtctgtgttgggtttgggggtagtcagaccctgtcaggacacagcatggacatgagggtccccgctcagctcctgggctcctgctgctctggctcccaggtacccagctgtgacaactccaattcgacccagtcctccatccctccctgtcctgcatctattgganacagatcaccatcacttggccggacgtagtacgaggcctaatcgaacggtcgtatttaccgtttacgtcccgttaggtttcgaccgagtaccgaaggtaaaacccggagggccgaaccgtaccccccgtgtaaccggtagttaccggttacgttacgtaacgtttcgggtacgacctaagttacccgtaaggttacgttacggtaaccgggttaaacgggggttcccgggttaaccccgaaccgtttaccggtaacgggtttaccgagggttacggacgtaacggttcgaccgtacttaaccggggttcgggaaaccgttaacggttacgttaaacccgtaccttacctaacccgttaacctaacggtacctaacgttacccggacttaccccgtggtaccgtaaccggttaccgttaacggttaaacgtttacgtttttaccgaaacgttttaaaacttttaacgtttaccgtttaaacgtaaccgtttaaaacttacgggtttaaacttacgttaaaacccgttcccgtaaccgggtttcgtaccgttaccgggaccggttaacggtaaccggtacggtaacggtaaccgtaaccgtaaccggtcgttaaggccggttaaccgagttaacccg

SEQ ID NO: 216470 - DNA, 650 bp, Homo sapiens
  misc_feature: GYAE6OF02JUGJ9.1.34.D01.1.454.CMB.1.raw
  modified_base (143)..(143): a, c, t, g, unknown or other
  misc_feature (143)..(143): n is a, c, g, or t
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (473)..(473): a, c, t, g, unknown or other
  misc_feature (473)..(473): n is a, c, g, or t
tcagacgagtgcgtcacgaccggtgctcgatttagatcgtctgtgttgggtttgggggtaggtcgagaccctgtcaggacacagcatggacatgagggtccccgctcagctcctgggctcctgctgctctgctccaggtaccngctgtgacatccaattgaccctagtctccatccctccctgtctgacattctattggagaccagagtcaccatccattggccgggcgagtccagggccatcgagcgattccttagcctggttnccagacagtaaccgnggacgacgccccgtgagtacgtcgtaagttctaagtggtacgactactccgaagtacttggacgtaaggggttccgggtccccgtaacttaccggtaacggttcgaacggttcgggctaaaggtcgtaccgtaagttcggcgggtaacagtaacgttaaccgtacgttctacctaactacgttaccagtaccnggtccctagacacgcctaagtactatttcgtaacgttaatttacgttactacgttaactaacgtaacgtttataacttaacgttacccgtagttacgtacggttcccgaacggtaaccggtacgtaacgggtaaggtaacgtacgtaaccgtaagttcggaggtacctacgtaaccg

SEQ ID NO: 216471 - DNA, 717 bp, Homo sapiens
  misc_feature: GYAE6OF02I1UEI.1.34.D01.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgganacagagtcaccatcacttgccggggcgagtcaggccatcgagcgattcttacgcctggttcgcagcaagaaaccgagggccgacgcccctanagactcgtagtctagtggtgcatccgagtacttgacgtaagggtcgggtacccagtccgaggttcgaggtcggcgaagtcgactacgttcgtagggaactaggtacttaaccacgttcctactaacgttactacgaacgtaccaacggtccgtagccaaccgggtaccttaaggtaacgttagtttttacgaacgtttaaaacgtttttaccttaacgttacgtaaacccgttaaacgttaacggtttaaactttaaccggttaacccggttaacccccgtttacgggttacgggtaaccccgggttttacccgggaacccggggtaaccgggggtaaacccggttaaacggggttacccgggtaaaacggtttaacccgtaaacccgggtaaggtttacgggtacgggtaccctttaccggaaacccg

SEQ ID NO: 216472 - DNA, 513 bp, Homo sapiens
  misc_feature: GYAE6OF02JGSBP.1.34.D01.1.454.CMB.1.raw
  modified_base (255)..(255): a, c, t, g, unknown or other
  misc_feature (255)..(255): n is a, c, g, or t
  modified_base (405)..(405): a, c, t, g, unknown or other
  misc_feature (405)..(405): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgattctttagcctggttncagcagaaaccagggcgagcccctcagatcgtagtctatggtgcatccagtattgcaagggtcgggtcccagtccaggttcaggtggcagtgcatcgtgggacagtattacactctcactatcgagcacgccctgccagcctagaacttntttgacttaatttacttactgtacaactagttatactacgtacccgtagtcgtacgtcggaccgtagggaacctaggtacgaagtacgaacgtacgtggcgtctgacc

SEQ ID NO: 216473 - DNA, 710 bp, Homo sapiens
  misc_feature: GYAE6OF02IZNQQ.1.34.D01.1.454.CMB.1.raw
  modified_base (196)..(196): a, c, t, g, unknown or other
  misc_feature (196)..(196): n is a, c, g, or t
  modified_base (463)..(463): a, c, t, g, unknown or other
  misc_feature (463)..(463): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattgganacagagtccaccatcacttcggccgggcgagtcaggccatcgagcgtattctttacgccgttggttcgcagcaacgaaaccgagggccgacgcccctgaagctccggtagtctagtggtcgactatccgagtagttggaaccgtaaggggttccggggtacccctaacgttacccggtaggtttaccgaaggtgggacgtacggtacgctaacgttcggtaggggaactaggtaacttaaccgacttaccttaaccgtactttaacnccgtacggaccgtacgtccgtcggacgtaacgtccgttaaggtaacgtttatttacgaactttaaactttttaacttaaccgttcgttaacgtaacgtttaagtttaaactttaaaccgttaccgttaaccccgttaacggtacgggttaaccggttcccgggaaccggttaacggggaacccggtaaagggtaccggtaacgtaacccgaaccggtaccggttaggttacggacgttccgaacccg

SEQ ID NO: 216474 - DNA, 594 bp, Homo sapiens
  misc_feature: GYAE6OF02FM8K7.1.34.D01.1.454.CMB.1.raw
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggngagtcaggccatcagcgtattcttagcctggtgcagcaagaacngggcacgccctnagactcgtatctatggtncatccgagattgcgtaagggtcgggtacccagtccgaggttcaggtggnagtnctagtcgtagggacagtactttacactcctactactatcagcagtcctagccagtcctaagtagttatttgacttaatttacttacgttgtaactaacgttaagttaactttacgtaaccgttaccccgttagggttacgggtaccggtttaccgggaacccgggtaggggtaaacccgtaaggggttaccgggtaagtacccggtaaaccggtaacggttgggtccggtaccgtaggaacccg

SEQ ID NO: 216475 - DNA, 576 bp, Homo sapiens
  misc_feature: GYAE6OF02JJUKW.1.34.D01.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcgagcgatttcttagcctggttncagcaagaaaccgngggcgacgcccctcagtatcgtagtctagtggtcgcactccagtattgcgtaagggtccgggtacccacgtaccgaggttcagtggcagtgcatcgtagggacagtactacactctaccactatcgagtcacgtcctgacacgtccgtagtaagttagtttcacttaattttattacgtgtaaccagttaattattaacgttaccgtacccgttaggtacggtaccgtcgggaccggtaacgggtaaccgtaaggtacggtaacgtacccgtaacggtaccttgggtaccggtacgtcgaacccg

SEQ ID NO: 216476 - DNA, 446 bp, Homo sapiens
  misc_feature: GYAE6OF02G70UI.1.34.D01.1.454.CMB.1.raw
  modified_base (327)..(327): a, c, t, g, unknown or other
  misc_feature (327)..(327): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (423)..(446): a, c, t, g, unknown or other
  misc_feature (423)..(446): n is a, c, g, or t
tcagacgagtgcgtcacgaccggtgctcgatttagatcgtctgtgttgggtttggggagtcaggccatcagcgattctttagcctggttgcagcagaaaccagggcgagcccctcagatcgtagtctatggtgcatccagattgcaaggtggggtcccatcccaggttcagtcggcagtgcatctgggacagattacactctcactagtcagcagcctgcagcctagaagtatttttgacctaaattttacttacctgtacaaactagttattatacgtaccccctagtggacgttcggccaggggaccaaggtgaatcaacgatgnggctgcaccatctgtcttcatcctttcccgctatctagaacgcaacttcgtctcggagcgggctggacaaacgggccgactagtagcngnctnacnnnnnnnnnnnnnnnnnnnnnnnn

SEQ ID NO: 216477 - DNA, 675 bp, Homo sapiens
  misc_feature: GYAE6OF02JBUNA.1.34.D01.1.454.CMB.1.raw
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggnagtcaggccatcagcgattcttagcctggttgcagcagaaaccagggcacgcccctnagatcgtagtctatggtgcatccagtattgcgaacggggttcgggtaccccagtcccgaggtttcgaaggttcggcaggttcgacctagtcgtaggggacaggtaacttaccgaccttcgtaccacttacgtcaacgtccaacgtcccgtggaccctacggtcccgtaggtaaacgttatttttcggaaccttaaagtttttacgtacttcggtaacctaaacgttatttaacgtttaacgttaaccgttaacccccgttaggttacgggtaacccggtttaccgggaacccggttaaacgggggaacccttaaacgggggttacggtaaaaccgggttaaccctaaacccggggttaaccgtttaggggtaaccgggtcccgttacggtaaccccg

SEQ ID NO: 216478 - DNA, 643 bp, Homo sapiens
  misc_feature: GYAE6OF02GWFRT.1.34.D01.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcagtcaggccatcagcgtattcttagcctggttgcagcaagaaaccgngggccacgcccctnagatccgtagtctagtggtgacatccgagtattcggacgtaacggggtcgggtccccaatccgtaggtttccaggtggctagtcgctaagttccgagggaactagtacttacgtacctctacaactagtcagcctagtcctcgacgtacgccgttaaggtaatttacgttttacgacgtttaaacttttcttaacggttcctaacgtaaaccgttaagttttaacgttaaaccgttaaccgttaaccccgttaggttaccgggttaccgtaccgggtaccggaacggggtaaacccgtaaggggtacggttaaactaccccggaacgtaaccggttggtacggtaccctacggtaacccg

SEQ ID NO: 216479 - DNA, 541 bp, Homo sapiens
  misc_feature: GYAE6OF02JAP4X.1.34.D01.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgattcttagcctggttgcagcagaaaccagggcacgcccctcagatcgtagtctagtggtgcatccagattgacgaagggtcgggtacccagtccgtaggttcaggtggcagtgcatcgtgggacagtacttacactctacactatcagcacgcctgcacgcctagaagttatttgacttaatttacttactgtactaactagttattaactacgtacccgttagtacggtaccgttccgggacgacggggtaccgtaagggtacggaacgtaccgaaccggtagttacggtcggtactgtacc

SEQ ID NO: 216480 - DNA, 699 bp, Homo sapiens
  misc_feature: GYAE6OF02HNLK6.1.34.D01.1.454.CMB.1.raw
  modified_base (225)..(225): a, c, t, g, unknown or other
  misc_feature (225)..(225): n is a, c, g, or t
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (397)..(397): a, c, t, g, unknown or other
  misc_feature (397)..(397): n is a, c, g, or t
tcagacgagtgcgtcacgaccggtgctcgatttagatcgtctgtgttgggtttggggagtcagaccctgtcaggacacagcatggacatgagggtccccgctcagctcctggggctcctgctgctctggctcccaggtaccagctgtgacatccaattgacccagtcctccatccctccctgtctgcattctattggagacagatcaccatccacttggccgggnagtccaggccatcagcgattctttagcctggttgcagcaagaaaccngggcgacgcccctnagactcgtaatctaatggtgctacgtaccaggtatttcggactaaggggtcgggtcccattccgaagggttcaggttggacctgtcgcagttcgagggaacagtactaacncgtactctaactacttacgacgcgaacgtccgtagaccgtacggacccttaggtaacgttaagtttttccggaacttaaaacgtttttaactttaccgacgttaacgtaaacgttacgtttaaactttaaacgttaaaacccgttaccccgggtttaaacgtacgggtttaaacccgggtttcccgggtaaccgggtaaacccgggggttaacggtaaaacccgggggttaaggtaaaccggtttaaccccggaaacccgggttaaacgtaccggggtttcggttaccgtacgggtaacccg

SEQ ID NO: 216481 - DNA, 541 bp, Homo sapiens
  misc_feature: GYAE6OF02JGC01.1.34.D01.1.454.CMB.1.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggnagtcaggccatcagcgtattcttagcctggttgcagcagaaaccngggcacgcccctnagatcgtagtctatggtgcatccagattgcgaagggtcgggtcccatccgaggttcagtggcagtgacatcgtagggacagtacttacactctcactactcagcagcctgcacgtcctagaagtacttttagacttaatttacttacgtgtacaactagttaattaactaccgtacccttaggtgtaccgttccggaccgaacggggtacctaagggtacggtaacgtaccgtaaccgtacgtggtacggtactaggtacc

SEQ ID NO: 216482 - DNA, 552 bp, Homo sapiens
  misc_feature: GYAE6OF02FFZ48.1.34.D01.1.454.CMB.1.raw
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtccaccatcaccttggcccgggcgagtcgaagggccagtcagcgtattctttagcctggttgcagcaacgaaaccgngggcgacgcccctnacgatcgtagtctagtggtgcatccagtattggacaaggggtcggtcccatccgtaggttcgaggtcggcagtgcagtcgtagggacagtacttacnctctacactancagcgacgcctgcacgcctagaatgtttagacttaatttataccgtagtacaacgtagttactaacgtacgtacccttaggtcgacgtccggaccgtaacgggaccgtaagggtacgaagtccgaaccggtaacgtggtcgactcggtacc

SEQ ID NO: 216483 - DNA, 542 bp, Homo sapiens
  misc_feature: GYAE6OF02HXSX7.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgacgcccctnagatcgtagtctatggtgcatccagattgcaaggtcgggtcccatccaggttcaggtggcagtgcattcgagggacaggattacactctcactatcagcacgctgcacgcctagaagtattttgacttaactttaatttacgtagttacaacttaagttacttaactacgttaccccgtaggttcggtacggtttccggaccgtacggggaacctaagggtacggaagtaccgaaccggtaactggtacggcctagtacc

SEQ ID NO: 216484 - DNA, 572 bp, Homo sapiens
  misc_feature: GYAE6OF02GXKG5.1.34.D01.1.454.CMB.1.raw
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (415)..(415): a, c, t, g, unknown or other
  misc_feature (415)..(415): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttgccgggcagtcaggccatcagcgattctttagcctggttgcagcagaaaccagggcacgcccctnagatcgtagtctagtggtncatccagtattggactaagggtcgggtcccagtccgaggttcaggtggcaggtcgctagtcgtagggacagtacttacactctacactatcacgcagcctgcacgcctagaacgttntttagacttaatttacttacgtatacaactagttaattactaaccgttaccccgtaggttaccggtacggtttaccgggaccggtaacggggtaacccgtaaggggtacggtaaacggttaccgaaaccggtacgttggtacggtccttaggtaccg

SEQ ID NO: 216485 - DNA, 591 bp, Homo sapiens
  misc_feature: GYAE6OF02GFPF5.1.34.D01.1.454.CMB.1.raw
  modified_base (549)..(549): a, c, t, g, unknown or other
  misc_feature (549)..(549): n is a, c, g, or t
tcagacgagtgcgtcacgaccggtgctcgatttagatcgtctgtgttggggtttggggcagtggaccagtcgacgggtccccgctcagctcctggggctcctgctgctctggctcccagtaccagtctgtgacagtccaattgacccagtctccatcctccctgtctgccatctagttggagacacgagtcaccatcacttgccggcgagtcacggtccaatcgagcgtattctttacgccttggttcgctacgacaacgaaaaccaggggtccgagcccctacaacgactacgtagtctactgggtcgcatacctagtattagacaaagggtacgggtaccctatccgacgttcgacggtgtcagtgcacgtcgtggggaacaggtacttacgacctcgtactactactcagtcacgcctagcagccgtagaagtatttcgacttaatttatactagtactaatagttattacgtacgtaccctaggttcgtacgttcggaccgtaggggaacgaaggtagtagtaccgaacgtactaggtcggtacncgactaccgtatccgttgtcctactacttccgtcccgtaccc

SEQ ID NO: 216486 - DNA, 849 bp, Homo sapiens
  misc_feature: GYAE6OF02HRJLP.1.34.D01.1.454.CMB.1.raw
  modified_base (127)..(127): a, c, t, g, unknown or other
  misc_feature (127)..(127): n is a, c, g, or t
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
tcagacgagtgcgtcacgaccggtgctcgatttagatcgtctgtgttgggtttgggggtaggtcgagacctgtcaggacacagcatggacatgagggtcccgctcagctcctgggctcctgctgctntggctcccaggtaccagctgtgacatccaattgacccagtcctccatccctcccgtgtcctgacacttctattggacgacngaagtcacactcacttgccgggcaagtcgacggccanacgagccgtattctttagctggttgcaggcacgaaacgcgggacgacacccccttanaggtaactcggtagtctagtcggtgctanaccaggtattcggacgtaaacgggtcggggttccctaactcccgggtaaggtttacaaccgggttgggacgtacggttaggaccaacggtttcctagggggtaaacccagtaaaccgtttccgaacctttaccgttacgaaccgttaattacccgaacggtaccacgggtaccttacccgggtacaacggggtacccttaacggtttaaaacgtagtttttttaacgggaacctttttaaaaaactttttttacggtaaacctttaccgggtttaaaccctaaacccgtaaaacggtttttaattttaaaaccgttaacccgttttaaacccccgttaacgggggttttaccgggtaaacccggttttttaacccgggacgggaaaccccgggggggtaaccggttttaaaaccggggaaaccgggggttaaacggttttaaaccccggaaacccgggggttaaaaacccgtttttacccgggggaacggttttaaacccggggccggttaaacccgg

SEQ ID NO: 216487 - DNA, 531 bp, Homo sapiens
  misc_feature: GYAE6OF02JEKQ7.1.34.D01.1.454.CMB.1.raw
  modified_base (282)..(282): a, c, t, g, unknown or other
  misc_feature (282)..(282): n is a, c, g, or t
  modified_base (432)..(432): a, c, t, g, unknown or other
  misc_feature (432)..(432): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccgagggcgacgcccctnagatcgtagtctatggtgcatccagattgacaaggtcgggtcccagtccaggttccaggtcggcagtgcatcgtagggacagtacttacactctacacttatcagcacgccgtgcacgtcctagaacgtatttcgattaatttattactntacaacgtagtattatacgtacctacggtgacgttcggaccgtagggacgtaacggtacggtaacgtaccgaaccgacgttggacggtcgtacgtaccg

SEQ ID NO: 216488 - DNA, 722 bp, Homo sapiens
  misc_feature: GYAE6OF02J1VFJ.1.34.D01.1.454.CMB.1.raw
  modified_base (225)..(225): a, c, t, g, unknown or other
  misc_feature (225)..(225): n is a, c, g, or t
  modified_base (379)..(379): a, c, t, g, unknown or other
  misc_feature (379)..(379): n is a, c, g, or t
  modified_base (534)..(534): a, c, t, g, unknown or other
  misc_feature (534)..(534): n is a, c, g, or t
tcagacgagtgcgtcacgaccggtgctcgatttagatcgtctgtgttgggtttgggggagtcagaccctgtcaggacacagcatggacatggagggtccccgctcagctcctgggctcctgctgctctggctcccaggtaccagctgtgacatccaattcgacccagtcctccatcctcctgtctgcatctattggacacagagtcaccatcacttggcccgggntagtcaggccatccgagcgtattcttacgtccgttggttcgacagccaacgaaccgagggaccaccgacccctcagactcgtagttctagttggtacgcactaccagtacgttcgacggtaacggttcgggaccctagtcccgtaggttaccgnggtacgggtactaggtcgaccgttagttcggacggggtactaacggtactaacctacttccttaacaccttaaattcgtaacggcctacgtccctggacctacggtacccgtaggttaaacgtttactttttacggattttaaaacccggttttnttaaaccggtcgttaaaccaacctttaacgtttaacttaacccggttaaacccgttaccccggtttaacgggtacggttaacccgggttttaccgggaaacccgggttaaccggggtaacgtaaaccggggtttacggaaaccgttacggttaaccggaacgtttcggtaacggtcctaggaaccccg

SEQ ID NO: 216489 - DNA, 576 bp, Homo sapiens
  misc_feature: GYAE6OF02I7H6Q.1.34.D01.1.454.CMB.1.raw
  modified_base (287)..(287): a, c, t, g, unknown or other
  misc_feature (287)..(287): n is a, c, g, or t
  modified_base (439)..(439): a, c, t, g, unknown or other
  misc_feature (439)..(439): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttggccgggcgagtcaggccatcagcgtattctttagccttggttcgcagcaagaaaccgagggcgacgcccctnagatcgtagtctagtccccggtgctatccagtattgacgaagggtcgggtcccagtccgacggttacgaggtcggactagtcgactagtcgtaggggacaggtacttaacctactctcctactagtacacgcacgcctgcacgctagtaatntttagactaatttattactgtacaacgttagttaacttacgtaccgtacccgtaggttcggtacggttccggaccggacgggtaaccgtaagggtacggaacgtaccgaaccgtacgtggtacggtactacggtacc

SEQ ID NO: 216490 - DNA, 534 bp, Homo sapiens
  misc_feature: GYAE6OF02I4WOF.1.34.D01.1.454.CMB.1.raw
  modified_base (198)..(198): a, c, t, g, unknown or other
  misc_feature (198)..(198): n is a, c, g, or t
  modified_base (409)..(409): a, c, t, g, unknown or other
  misc_feature (409)..(409): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggttgcagcagaaaccgagggcgacgcccctcagactcgtagtctatggtgcatccagattgacgaagggtcgggtacccagtcccgaggttcaggtggcagtgcagtcgtagggacagacttacactctcactatcagcagcctgcagctagaatntttagacttaatttacttactgtactaactagttaattactaacgtaccctaggtacggtacgttacggccgacgggaccgtaaggtaggaacgtccgaaccgtagttggtcggtcctagtaccg

SEQ ID NO: 216491 - DNA, 599 bp, Homo sapiens
  misc_feature: GYAE6OF02HDNFF.1.34.D01.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagccttggttgcagcaagaaaccgagggccgacgcccctnagtatcgtagtctagtggtgcactccagtattgacgtaagggtcgggtacccacgtccgtaggttcaggtggacgtagtgtctatcgtacgggacagtacttacgactctacaattactacacgcacgtccgtgacacgtccgtagtaagttacttttacgacttaaattttacgttacgttagtaacctaagttaagttaactttacgtaaccgttacccgtacggttacgtacggttaccgggaccggtacgggtaacgtaacgggtacgtaacgtaccgtaaaccggtagtcggtaggtcctaggtaaccg

SEQ ID NO: 216492 - DNA, 634 bp, Homo sapiens
  misc_feature: GYAE6OF02JH1I9.1.34.D01.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
tcagacgagtgcgtcacgaccggtgctcgatttagatcgtctgtgttgggtttgggggaggtcagaccctgtcaggacacagcatggacatgagggtccccgctcagctcctgggctcctgctgctctggctcccaggtaccagctgtgacatccaattgacccagtctccatcctccctgtctgcatctatgganacagatcaccatcacttggccgggngagtcaggccatcagcgattcttagcctggtcncagcagaaccngggcacgcccctgacgatcgtagtctagtggtcncactccaagtacttggactaaggggtcgggtacccagttcccgaggttcaggttcggcaggtcnctattcgagggacaaggtacttacccgacttcctacgtactactacgacgcgaccgtccttggccaacggcccttaagaacgtttatttacgaccttaaagttttacttacgtcgtaacctaaacgttagttaacttttaacgtaaccttaacccctaggggttaccgtaaccggtttccggtacccgggtaacggggtaacctaagggggtaaccggtaacggtacccgaaaacccggtacggttacgggtcgggtactaccggtacccg

SEQ ID NO: 216493 - DNA, 857 bp, Homo sapiens
  misc_feature: GYAE6OF02HMVMY.1.34.D01.1.454.CMB.1.raw
  modified_base (102)..(102): a, c, t, g, unknown or other
  misc_feature (102)..(102): n is a, c, g, or t
tcagacgagtgcgtcacgaccggtgctcgatttagatcgtctgtgttggggttggggagtcagaccctcgtacaggacacagcatggacatgagggtccccntcagctcctgggctcctgctgctctggctcccaggtaccagctgtgacagtccaattcgaccctagtcctaccatccctccctgtcctcgtctattctataggacgaacaggtacgtaccaaccgtacttccaacgttcggaccccgggtacgtacgtccgaacgggccctaagttaccgaaggtaccgttaattttaaccgttttaacgtaccgtttaagggttcgaccgtaaggacccgaaacggaaaacccggacgggggaaccgaacccggtccccccgttacgaacggtaccttaccggttaaacgttcctttaacggttacgggtagtacccgtaacgttacccgaaaggttaacgtacggaacggtaacgggggttcccgggtaacccgtaggttaccggtaacgggtttcgaaacgggttcggtacgtaggtcggactacggttaccgtacgggtaacctacgtaacttaccgtacgtacctacctaactacgtacgacgctacggtaccgtagtaccgtaacgtcccgttaaagtaacgtttacgtttactaacgttaacgttttaacgtacgttacgttaacctaacgtttaacgttactttaaccgttaacccggttaccgtttaaccgggttcccgggttaaccggttcccgggaaccgggtaacgggtaccggtaacgggttaacggaaaccgttacccggaaacggttaaccggttgggtaccggttacgtaacgtacccg

SEQ ID NO: 216494 - DNA, 1200 bp, Homo sapiens
  misc_feature: GYAE6OF02I93KK.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctagttggagacagacgtcaccatcacgttcggccgggcgagtcgacggccatccgagcgtatttccgtttacgtccgtggttcgctaacggacgaacgaaaaccgaggggaccgacggtaccccctacgacggtacgtcggttacggtacgttaggtcgggtcgacctacgtaccgagttagttcggaccggtaacggggttcggggttacccctaacggttacccgtaacgggttttacgacgggttacgggtaccgtaacgggttacggtaccgtacggtttacccgggtttaacggggggtaaaccgttaaccgggtttaaaccgtttaaaccccgttaaacccggtttttaccccgttaaacccctttaaaacccggtttaaaaccgtttacccggtaaaacccgggttaacccgtaaacccgggttacccccggttaaccgggtaaccccggttaaaaccccggggtttttaccccccgggtttaaaaaggggggttaaaaacccggggtttttttttaaacccgggttttttttttttaaacccggggggtttaaaaaaccccccgttttttttttaaaaaaaacggttttttttttttttaaaaccccccggggttttttttttaaaaaaaacccccgggggttttttttttaacccccccgggggggttttttttaaaaaaaaacccccccgtttttaaaaaaaaccccgggggtttttttttaaaaaaaacccgggggggtttttttttttttaaaaaaaacccgggtttttttttttttaaaaaacccccccccgggttttttaaaaaaaaacccccccccgggggggtttttttttttaaaaacccccccccccccccgggggggtttttttttaaaaaccccgggggggggggtttttttttaaaaaaccccccccggggggggggtttttttaaaaaccccccccgggggggggggttttttttttaaaacccccccccccgggggggggggggtttt

SEQ ID NO: 216495 - DNA, 577 bp, Homo sapiens
  misc_feature: GYAE6OF02G2GJV.1.34.D01.1.454.CMB.1.raw
  modified_base (222)..(222): a, c, t, g, unknown or other
  misc_feature (222)..(222): n is a, c, g, or t
  modified_base (390)..(390): a, c, t, g, unknown or other
  misc_feature (390)..(390): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgtattctttagcctggttgcagcaagaaccagggcgacgcccctacaggacttcggtagttctagtgggtgacactccagattcggcgaagggtcgggtacccagtccgtaggttcagtggcagtcgcatcgtgggacagtagttacacctntacacttatcagcagcctgcctagcctagtagttatttgacttaatttacttaacgtagttactaaacgttagttaactttaactaccgttaaccccgtagttacggtaccggttccggacggaacggggtaaccgtaagggtacgtaacgtaccgaaccgtaacgttggccgtacgttacgaaccc

SEQ ID NO: 216496 - DNA, 494 bp, Homo sapiens
  misc_feature: GYAE6OF02G83JT.1.34.D01.1.454.CMB.1.raw
  modified_base (392)..(392): a, c, t, g, unknown or other
  misc_feature (392)..(392): n is a, c, g, or t
  modified_base (442)..(442): a, c, t, g, unknown or other
  misc_feature (442)..(442): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcagaaaccagggcgagcccctcagatcgtagtctatggtgcatccagattgcaaggtggggtcccatccaggttcagtggcagtgcatcgtgggacagattacactctcactatcagcagcctgcagcctgaagattttgctaatttattactgtcaanagttattatagtacccctagtcggaccgttcggacctaggggaccaaggngaagtaccacgactggtggctgccaccatctgtcttcacttctccctacccg

SEQ ID NO: 216497 - DNA, 642 bp, Homo sapiens
  misc_feature: GYAE6OF02I0VAU.1.34.D01.1.454.CMB.1.raw
  modified_base (106)..(106): a, c, t, g, unknown or other
  misc_feature (106)..(106): n is a, c, g, or t
  modified_base (132)..(132): a, c, t, g, unknown or other
  misc_feature (132)..(132): n is a, c, g, or t
  modified_base (263)..(263): a, c, t, g, unknown or other
  misc_feature (263)..(263): n is a, c, g, or t
tcagacgagtgcgtcacgaccggtgctcgatttagatcgtctgtgttggggtttgggggagtcagaccctgtcgaggacacagcaagtggacatgagggtccccgntcagctccgtggggctcctgctgctntggctcccaggtaccagctgtgacatccaattcgacccagtctccatccctccctgtctgcatctattggagacagatcaccatcacttggccgggcgagtcaggccatcagcgtattcttagcctggttncagcaagaaccgagggcgacgcccctgagactcggtagtctagtggtcgacatccgagtattgacgtaaggggtcgggtaccccagttcccgaggttcaggtggctagtcgactagtcggtagggaactaggtaacttaccgacttccgtactaacttactacgaacgtccgaacgtccctggacctacggtccttaggtaagttcgttttacgaactttaagtttttacttaccgtagttaactaacgttagtttaacttaacgtaaccgtttacccgttaggtacggtaccggttccggaaccggtacggggtaacgtaaggggtacggtaacgtaacccgaaccggtaacgttgggtacggtccgtacgtaacccg

SEQ ID NO: 216498 - DNA, 691 bp, Homo sapiens
  misc_feature: GYAE6OF02GIETK.1.34.D01.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattcttagcctggttgcagcaagaaaccgagggcgacgcccctnagatcgtagtctagtggtgcatccagtattgacgtaagggtcgggtacccacgtccgtaggttcaggtcggactaggtgactagttcggtagggaactagtaacttacaccgttcctacgtaacttactccgagaccgtacggtcccttaggacctaacggtcctaaggtaaacgtttacgtttttacgaacttttaaattttacgtttaaccgtagttaacccgtaaacgttaacggtttaaactttaaaccggttaacccgtttaacccccgttaaggggttaccgggttaacccgggtttaccggggaacccggtaaacggggggtaacccgtaaacggggttacggtaaaccggttacccgaaaccggttaccgttacgggtacggtaccgtacggtaacccg

SEQ ID NO: 216499 - DNA, 603 bp, Homo sapiens
  misc_feature: GYAE6OF02J2A2W.1.34.D01.1.454.CMB.1.raw
  modified_base (143)..(143): a, c, t, g, unknown or other
  misc_feature (143)..(143): n is a, c, g, or t
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
  modified_base (456)..(456): a, c, t, g, unknown or other
  misc_feature (456)..(456): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccngctgtgacatccaattgacccagtctccatccctcctgtctgctatctatgganacagactcaccatcacttggccgggnagtcaggccatcagctattcttagccgtggttgcagcgaacgaaaccgngggccacgcccctgagatcgtagtctagtggtagctactccgagtagttcggacggtaacggggttccgggtaccctaagttccgtaaggttccgaggttcggcaggtcgactacgtcggagggactagtacttacgacttctacactatacgacgacacgtctgactacgccgtagaacgttnttttcggaactttaagtttactcgtacgtaacaacgtttagtacttaacgaccgttaccctaggtcgtaccgttccgggaaccggtaacgggcttaaacgggtacgaacgtaccgaaaccggtattcgggtcgtaccgtgtaacccg

SEQ ID NO: 216500 - DNA, 429 bp, Homo sapiens
  misc_feature: GYAE6OF02HKQEH.1.34.D01.1.454.CMB.1.raw
  modified_base (305)..(305): a, c, t, g, unknown or other
  misc_feature (305)..(305): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (395)..(396): a, c, t, g, unknown or other
  misc_feature (395)..(396): n is a, c, g, or t
  modified_base (400)..(429): a, c, t, g, unknown or other
  misc_feature (400)..(429): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctagaagtattttgactaatttattactgtacaactagttattatactaccctagtgacgtcgcgagggacaggtgatcacgatgngctgcacatctgtctcactcctccgctatcacgactcactcgtctcggacggcgggtactgggacgtaacgggcgtacgaagtgntgntnntacnnnnnnnnnnnnnnnnnnnnnnnnnnnnnn

SEQ ID NO: 216501 - DNA, 534 bp, Homo sapiens
  misc_feature: GYAE6OF02FG2BH.1.34.D01.1.454.CMB.1.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (435)..(435): a, c, t, g, unknown or other
  misc_feature (435)..(435): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggcgagtcaggccatcagcgattctttagcctggtncagcaagaaaccngggcacgcccctnagatcgtatctatggtgcatccagtattgacgaagggtcggggtcccagtccgtaggtttccaggttcggctaaggtcgactagtcgtagggacagacttacacttcacactatcagcagcctgcagcctgaatatttgacttaattattactntacaatagtattagtacgtacccgtagtggtacgtcggaaccgacggggaaccgtaagggtcggaacgtaccgaacgtaacgtggtacggtctgaaccg

SEQ ID NO: 216502 - DNA, 675 bp, Homo sapiens
  misc_feature: GYAE6OF02H5VBN.1.34.D01.1.454.CMB.1.raw
  modified_base (226)..(226): a, c, t, g, unknown or other
  misc_feature (226)..(226): n is a, c, g, or t
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctccctgtctgcatctattggagacagacgtcaccatccacttggccgggngagtcaggccatcagcgtatttcttagcctggtncagcagaaccngggccacgcccctanagatcggtatctagtggtcgcactccagtacttggacgtaaggggtcggtacccagtccgtaggttcaggtcggacgtagtagcctagttcgtagggaactagtaacttacgacttccgtacaacttactacgacgcctacgtccgtagaccgtacgtaccgttaagtaaacgttcgttttacggaactttaaagttttacttacgttacgtaacctaaacgtttaacgttaacgtttaaacgtaacccggtttaaccccgttcgggttaacgggtacccggttttaccgggacccggtaaaccggggtaaccgtaaaggggttaaccggtaaacgttaccccggaaaccggttaacggttccgggtacggtacccgtacgtaaccccg

SEQ ID NO: 216503 - DNA, 673 bp, Homo sapiens
  misc_feature: GYAE6OF02H06DD.1.34.D01.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttgccgggcgagtcaggccatcagcgattcttagcctggttgcagcaagaaaccngggcgacgcccctnagntcgtagtctagtggtgcactccagattgcgaagggtcgggtcccagtcccgtaggttcaggtcggacaggtcgactacgttcgtacgggactaaggtaactttaaccgtacttaccgttactaaccttagtaccaacggtaccaccggtccgtacgaccacggttacccgtagtaacggttattttacggaactttaaatttttaacgttacgttacgtaacctaacgttaagtttaacttaaacgtaaccgtttaaccccgttaagggttaccgggtaaccggtttcccgggaaccgggtaacccgggggtaaccgtaaacggggttacggtaaaccgtacccggtaaaccggtacccggtttaggtaccgggtcgttaccggacccc

SEQ ID NO: 216504 - DNA, 626 bp, Homo sapiens
  misc_feature: GYAE6OF02IU8H7.1.34.D01.1.454.CMB.1.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
  modified_base (370)..(370): a, c, t, g, unknown or other
  misc_feature (370)..(370): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatccctccctgtctgcatctattgganacagagtcaaccatcacttgccggggcagtccaggccatcgagcgtattctttacgccttggttcgacagacaagaaaccgagggcgacgcccctacgagactacgtagtctagtggtncatcagtattgacgtaagggtcggtcccagtcctaggttcagtggactaggtcnctactcggtagggaacagtaattaccgaactctacactatcgacgactacgcctagcgtacgtctagtaagtattttacgactttaaatttacgttacctagttaaccgtaacttaacgttaactttaacgtaacgttaccccgttagggttacggtaccggttttacgggacccggttaacgggggaacgtaaacgggtaacggtaacgttaacccgtaaaccgggtaacgttaggtccggtaccgtcgtaaccg

SEQ ID NO: 216505 - DNA, 570 bp, Homo sapiens
  misc_feature: GYAE6OF02JXNWQ.1.34.D01.1.454.CMB.1.raw
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttggccgggcgagtcaggccatcagcgatttcttagccttggttgcagcagaaaccgagggcgacggcccctgacgatcgtagtctacgtggtagcatccagtcttggcgtaagggtcggggtccccagtccgaggttcaggttcggcgagtcgcagtcgtggacgagtactacactctcactanctacgcacgctcgacngtacctagattactttgacttaatttattcgttagtacaacgtattattaccgttaacgtacccgttaggtcgtacggttacggcgaacgggactaaggcgtaacgaccgtaccgacgtggtcggtctacggtaccgacctagttacgtcgtacttacgtccttcccgtacccgtcccccg

SEQ ID NO: 216506 - DNA, 559 bp, Homo sapiens
  misc_feature: GYAE6OF02GHHPO.1.34.D01.1.454.CMB.1.raw
  modified_base (275)..(275): a, c, t, g, unknown or other
  misc_feature (275)..(275): n is a, c, g, or t
tcagacgagtgcgtcacgaccggtgctcgatttagatcgtctgtgttgggtttgggcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggcgacgcccctcagatcgtagtctatggtncatccagattgcgaaggtcgggtcccatccaggttcagtggcagtgcatcgtgggacagtatacactctcactatcagcagcctgcagccgtagtaagtactttgactaaattttagttactcgtacaaactagttaattaacgttacgttaaccccgttaggtcggtacgttccgggaccggtacggggaacctaagggtaggaacgtacgaacccgtacgttcggtcggtacctacggcctaaccgagttcgttcgttccttcgaccttccctcccgtaccc

SEQ ID NO: 216507 - DNA, 573 bp, Homo sapiens
  misc_feature: GYAE6OF02I3M57.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagctggttgcagcagaaaccagggcgacgcccctcagactcgtagtctagtggtgcactccagtagttcgacgtaagggtcgggtcccagtccaggttcagtggcagtcgctacgtcgtagggaacaggtaacttacactctactacttatccgagccacgcctagcacgtcctagaagttattttgacttaatttacttactacgtactaacgtagttaattacgtaacgttaccccgtaggtcggtaccgttcggtacccggtaaggggaacctaaggggtaggtaaccgtaccgaaccggtaacgtggtacggtacgtggtaccc

SEQ ID NO: 216508 - DNA, 629 bp, Homo sapiens
  misc_feature: GYAE6OF02GS8RX.1.34.D01.1.454.CMB.1.raw
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
tcagacgagtgcgtcacgaccggtgctcgatttagatcgtctgtgttgggtttggggggaggtcagaccctgtcaggacacagcatggacatcgagggtccccgctcagctcctggggctcctgctgctctggctcccaggtaccgagctgtgacatccaattgacccagtctccatcctccctgtctgcatcgtattggagacagacgtccaccatcgacttggccgggcaagtcagggccatcagcgtattcttagcctggttcncagcagaaccngggcgacgtcccctacgagactcgtagtctagtggtcgctactccaagtattcggacgtaaggggttcgggtacccagtccggtaggttcgaggtcggactggtcgctacgtcggtgggaacaggtacttaccgacttcctactactagtaccaggtcacgtccgttagcctaacgtccttaaggtaatttgtttacgaactttaagttttacgttaccgtgttaacctaacgttacgttaacttacgtaaccgttacccgtaggttacggtaccggttccggacggtaacgggtacgtaagggtaccggtaacgtaccgaacggtacgttgggtacgttcgacgtacccg

SEQ ID NO: 216509 - DNA, 638 bp, Homo sapiens
  misc_feature: GYAE6OF02G78C1.1.34.D01.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (288)..(288): a, c, t, g, unknown or other
  misc_feature (288)..(288): n is a, c, g, or t
tcagacgagtgcgtcacgaccggtgctcgatttagatcgtctgtgttgggtttgggggtagtcagaccctgtcaggacacagcatggacatgagggtccccgctcagctcctgggctcctgctgctctggctcccaggtaccagctgtgacatccaattcgacccagtctccatccctccctgtcctgacatctattgganacagactcacatcacttgccgggcagtccaggccancagcgattcttagctggttcgctagctaacgaaaccagggcgacgcccctnacgtatcgtagtctaagtcggtacgcaactccagtacttggactaagggtcgggtacccattaccgaggttacacgtggcgtagtcgtacagttcgtacgggactaggtacttacgacttcgtactactagtcaagtcaacggtcctgcctacggtacctaggtaaacgttattttacggaacttaaagtttttactacttacgtacctaaaacgttaggtttaacttaaacgtaaccgttaccccgttaaggttacggttaccggttaccgtaccgggtaacggaaccggttaaacggccggtaaaggtccgtaaaccggtacggtacgttacggcgttaccgtaaccg

SEQ ID NO: 216510 - DNA, 638 bp, Homo sapiens
  misc_feature: GYAE6OF02IHOCC.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatccctcctgtctgcatctattggagacagagtcaccatcacttcggccgggcgagtcaggccatcagcgtatttctttagccttggttgcagcaagaaaccgagggcgacgcccctcagactcgtagtctagtggtgcactccagtattggacgtaagggtcgggtacccagtccgtaggttcaggtcggactggtcgctatcgtagggacagtattacactctacactactacgacgacacgtcctgacctacgtacctaggtaacgtttattttacggactttaaacgtttttaacttacgttacgttaactaaacgttagttttaaacttaacgttaccgttaaccccgttaggttacgggtacccggtttaccgggacccggtaacgggtaaccggtaaacgggtacgggtaaacgttacccggaaaccggtacgttagggtaccggtccgtacgtaacccg

SEQ ID NO: 216511 - DNA, 586 bp, Homo sapiens
  misc_feature: GYAE6OF02FZT9C.1.34.D01.1.454.CMB.1.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (421)..(421): a, c, t, g, unknown or other
  misc_feature (421)..(421): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggngagtcaggccatcagcgattcttagcctggttgcagcaagaaccngggcgacgcccctnagatcgtagtctagtggtncatccagtattgcgtaagggtcgggtcccatccgaggttcaggtggacagtgcatcgtacgggacagtacttaccactctactactatcaggccagtccctgaccgagtccctagaacgtnttttagacttaatttacttacgtacgtactaactagttaattacgtaccgtaccccgttaggttcggtaccggtttccggaccggtaaggggtaaccctaaggggttacggtaaacggttaccgtaaacccggtacggttcggtacgggtacctacggtaacccg

SEQ ID NO: 216512 - DNA, 540 bp, Homo sapiens
  misc_feature: GYAE6OF02HM73U.1.34.D01.1.454.CMB.1.raw
  modified_base (388)..(388): a, c, t, g, unknown or other
  misc_feature (388)..(388): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagatcaccatcacttgccgggcgagtcaggccatcagcgattctttagcctggttgcagcagaaaccagggcagcccctcagactcgtagtctatggtgcatccagatttgacgaaagggtcggggtacccagtccaggttcaaggttggcagtgacatcgtagggacagattaacacttctcactatnagcagcctgacagcctagaagtattttgacttaaattttattactgtacaatagttaattataaccttacccgtagtggtacgttccgggaccgaaggggaacctaagggtaggaacgtaccgaaaccgtaagtggtacggtcctagtaccg

SEQ ID NO: 216513 - DNA, 529 bp, Homo sapiens
  misc_feature: GYAE6OF02HGS37.1.34.D01.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattcttagcctggttgcagcaagaaaccagggcacgcccctnagatcgtagtctatggtgcatccagattgcgtaagggtcggggtcccagtccgtaggttcaggtggacagtgctagtcgtagggactagacttacactctacactatcagcacgcctgcacgcctagaacgtatttagacttaaattttactactgtactaactagtaattactacgtaccctagtcggtacgttcggacgacgggactaaggtacggaagtacaacggactggtacggtctagacc

SEQ ID NO: 216514 - DNA, 618 bp, Homo sapiens
  misc_feature: GYAE6OF02GCX2T.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcacatcacttggccgggcgagtcaggccatcagcgtattcctttagccgttggttcgactagccaagaaaaccgaggggcgacgtccccctgagactacggtagtctagtggtgctatccgaagtattgacgtaagggtcgggtcccatccgaggttcaggtggactagtgcagtcgtagggacaggtattaccactctacactatcagcgagcctagacacgtcctagtaagtattttacgactttaaattttacttacgtacgttaactaacgttaagtttaacttaaacgttaacccgttaccccgttagggttacgggtaccggttaccggacccgggtaacggggtaaccgaaggggttacggaaccgttaccgaaccggtaacgttcggtcggtaccgtcgtaacccg

SEQ ID NO: 216515 - DNA, 717 bp, Homo sapiens
  misc_feature: GYAE6OF02GGRLI.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcagtcaggccatcagcgtattcttagcctggttgcagacaagaaaccgagggaccgacgcccctagagtacgtacgttaagtcgtagtggtagcctactccagtattcgacgtaacggggttcgggtacccagtaccgtaggtttaccaaggttcggactaggtctacgtacgtcggtgggaacagtaacttaaccaccgttctactaacttagtaccaggacctacgccttacgaccgtacgtaccgttaaggtaaacgtttattttacgtaaccgtttaaattttacgtttactacggttaaacctaaacgttaacgtttaaatttaaaccgttaacccgttaaccccgttaacgggttacggggttaacccggttaccgggggtaacccgggtaaaggggtaacccgggttaaaagggttaccgggtaaaaccggttacccgtaaaacccgggttaacggttcgggtaccggtaccggttacggtaacccccg

SEQ ID NO: 216516 - DNA, 550 bp, Homo sapiens
  misc_feature: GYAE6OF02H2W7O.1.34.D01.1.454.CMB.1.raw
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (436)..(436): a, c, t, g, unknown or other
  misc_feature (436)..(436): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgtattctttagcctggttgcagcaagaaccgagggccacgcccctanagatcgtagtctagtggtncatccagtattgacgaaggtcgggtcccagtacgaggttcgaagtcggctagtgctagtcgtagggaactaggtattaaccacttcctacctaacttactcaacgcacgtcctgacacgcctagtaacgttntttacgacttaatttattactgtacaatattattactacgtacctagtgtaccggtcggacgtaacgggaccaaggtacggaacgtaccgaaccgtagtcggtcgcgtataccg

SEQ ID NO: 216517 - DNA, 691 bp, Homo sapiens
  misc_feature: GYAE6OF02HQ56K.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggagagtcaggccatcgagcgtatttctttagcctggttgcagcaagaaaccgagggacgacgcccctcagacgtcgtagtctagtggtcgactatccaagtattcggacgtaaggggttcggggtaccccattccgtaggttccgtaaggttcggaccgtaggtcgacctaagttccggtaagggggaactaaggtaactttaacccgtaccttaccgttacctaacttaactccgaacgtccacggtccctacggacccgtacggacccgttaaggtaaacgttacgtttttacggaacctttaaacttttttacgttaacgttacgttaacctaaacgttaagtttaactttaacgttaacccgtttaacccgttacgttacgggttaccgttaccgggaaccgaacgggggtaaccaagggttacggaacgtaaccgaaccggtaacgttggtacggtctcgtaaccc

SEQ ID NO: 216518 - DNA, 697 bp, Homo sapiens
  misc_feature: GYAE6OF02JJNRU.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctattgaagacagacgtcacatcacttgccgggcagtcaggccatcagcgattctttagccttggttgcagacacgaaaaccgagggcgaacgcccctcgagactacgtagtctatgggtgacatccagtacttggacgtaaggtcggggtacccagttaccgaggtttacgaaggtcgggacgtacggtcgactaacgttaccggttggggaactaaggtaactttaaccgtaccttaccgttaccaacctttagtaccgtaacgtaccgaacgtccctaggacctaacgtcccgttaggaaacgtttagtttttacgacgtttaaactttttacgtttaaccgttagtaccgtaaacttaggtttaatttaacggttaaccgttaaccccgttaaggtttccgggtaacgttccgggtaacccggtaaacgggtaccggtaaacgggtaacgggtaaacgttacccgtaaaccggtaacggtttggtaccggtaccgttacgaacccg

SEQ ID NO: 216519 - DNA, 639 bp, Homo sapiens
  misc_feature: GYAE6OF02JE0I3.1.34.D01.1.454.CMB.1.raw
  modified_base (200)..(200): a, c, t, g, unknown or other
  misc_feature (200)..(200): n is a, c, g, or t
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (323)..(323): a, c, t, g, unknown or other
  misc_feature (323)..(323): n is a, c, g, or t
  modified_base (461)..(461): a, c, t, g, unknown or other
  misc_feature (461)..(461): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtctccatcctccctgtctgctatctagttgganacagacgtcaccatcacgttcggccgggcgagtccacggccatcgagccgtatttctttacgcctggttcgcaggcaagaaaccgngggcgacgtcccctanacgtatcgtagtctagtggtncatccgagtatcgacgtaagggtcgggtacccagtccgtaggttcaggtggcagtgctagtcgtaggacaggtactacacctctacacttatcgacgtacgacgtccttcggaccgtactccggttaagtaacgtttntttaccggtaattttaacgtttacttacgttactaaaccgtaagttaacgtttaacttaaccgtaacccgttaacccgttacggtcgttaccggtccgggaaccggtaacgggtaccgtaaggggtaccgttaaccgaacggtaaccggttagtccgggtacgtacgtccgtaacccg

SEQ ID NO: 216520 - DNA, 427 bp, Homo sapiens
  misc_feature: GYAE6OF02GXSP6.1.34.D01.1.454.CMB.1.raw
  modified_base (319)..(319): a, c, t, g, unknown or other
  misc_feature (319)..(319): n is a, c, g, or t
  modified_base (404)..(427): a, c, t, g, unknown or other
  misc_feature (404)..(427): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagtattttgactaatttattactgtacaatagttattatacgtacccctagtggtacgttcggccgagggaccaggtgaagtcaacgactgtggcngcacatctgtctcactcctcccgctatctacgaacgctaacgtccgtctggacgtcgggtctcggacgaacggtcgactagtagnnnnnnnnnnnnnnnnnnnnnnnn

SEQ ID NO: 216521 - DNA, 590 bp, Homo sapiens
  misc_feature: GYAE6OF02IEKZ6.1.34.D01.1.454.CMB.1.raw
  modified_base (195)..(195): a, c, t, g, unknown or other
  misc_feature (195)..(195): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctcctgtctgcatctatgganacagagtcaccatcacttggccgggcagtcaggccagtcagcgtatttctttagcctggttgcagcaagaaaccgaggggccgacgcccctacagacttacgtagtctagtggtgcatccagtattgacgaaggggtcgggtacccagtccgtaggttcaggtcggacagtgctattcgtagggactagtacttacactctacacttatcagcacggcctgacgagacctagaattactttagacttttaatttacgttacctagtaacaacttagttaacttaacgtaccgttaacccgttaggtaccggttaccgtttaccgggcggaaacgggtacccggtaaagggtacgaaacgtaccgtaaaccggtagttcggtacgacttcggaacc

SEQ ID NO: 216522 - DNA, 650 bp, Homo sapiens
  misc_feature: GYAE6OF02G6TCM.1.34.D01.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (324)..(324): a, c, t, g, unknown or other
  misc_feature (324)..(324): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagacgtcaccatccacttcggccgggcgagtccgacggccatcagcgtatttctttagcccgttggttgcagccaagaaaccgnggggccacgcccctgaacgtactcggtagtcctagtgggtnctactccgagtattcggacgtaaggggttccgggtaccctagtcccgtagggtttacagggttcggactaggttcgactacgtcggtagggaacctaggtaactttaccgacctttccgttaaccgaaccttaacgtccgaacggtaccgtaaccgtccgttacggcccgtacggttaccctaggtaaacgtttacttttacgactttaaagttttacttactacgtactaacgtagttacttacgtacgtacccgtagtcgtacgttcggccgagggtaacctagggtcgaacgtacgaaccggtagttcggtcgtcgtgtaccg

SEQ ID NO: 216523 - DNA, 633 bp, Homo sapiens
  misc_feature: GYAE6OF02HO953.1.34.D01.1.454.CMB.1.raw
  modified_base (449)..(449): a, c, t, g, unknown or other
  misc_feature (449)..(449): n is a, c, g, or t
tcagacgagtgcgtcacgaccggtgctcgatttagatcgtctgtgttggggtttgggggagtcagaccctgtcaggacacagcatggacatgagggtccccgctcagctcctggggctcctgctgctctggctcccaggtaccagctgtgacatccaattgacccagtctccatcctcctgtctgcatctattggagacagagtcaccatcacttgccgggcagtcaggccatcagcgattctttagcctggttgcagcagaaaccagggccgagcccctacgagtacgtcgtacgtctaagtggtgcactccagtattggacgaagggtcgggtcccagtccgaggttacagtcggctagtgactagtcgtagggactagtacgtttacacgtacgtacaacgtatacgacgccaagtcctacgacgtacgacccgttagaaacgttntttacggacttaaacgtttttacgttaaccgttagttaccaaacgttacgttaacgtttaacttaaccgttaaccccgttaggtaccggtacgttaccgggtaaccgtacgggggtacctaaagggtacggtaaacgttccgaaacccggtaacgttacgggtacggtaccgtacggtaacccg

SEQ ID NO: 216524 - DNA, 552 bp, Homo sapiens
  misc_feature: GYAE6OF02HMKSU.1.34.D01.1.454.CMB.1.raw
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
tcagacgagtgcgtcacgaccggtgctcgatttagatcgtctgtgttgggtttgggggagtcagaccctgtcaggacacagcatggacatgagggtccccgctcagctcctgggctcctgctgctctggctcccaggtaccagctgtgacatccaattgacccagtctccatcctccctgtctgcatctattggagacagagtcaccatcacttggccgggcgagtcaggccatcagcgattctttagcctggttgcagcagaaaccngggcgacgcccctnagatcgtagtctagtggtcgcatccagattgacgaaggtcgggtcccatccaggttcagtggcagtgacatcgngggacagtactaaccactctacactatcgagcacgcctgcacggtactagtaacgtattttgacttaatttacgttacgtataccaacttaggttaattaactacgttaacccgtagtacggtacggttccgggacgtacggggaacgtaagggtacggtaacgtacgaaccggtactacggtgtcgtacgtaccg

SEQ ID NO: 216525 - DNA, 619 bp, Homo sapiens
  misc_feature: GYAE6OF02GPGM1.1.34.D01.1.454.CMB.1.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagacgagtgcgtcacgaccggtgctcgatttagatcgtctgtgttggggtttgggggagtcagaccctgtcaggacacagcatggacatggacgggtccccgctcagctccgtggggctcctgctgctctggctcccaggtaccagctgtgacatccaattcgacccagtctccatccctccctgtctgcatctagttggagacagacgtcaccatcacgttcggccgggcgagtcaggccatcagcgtatttcttagccttggtcncagacaacgaaaccgngggaccgaccgcccctagagactcggtagtctagtggtncactcagtatgacgtagggtcggaccagtccgtaggttcgaggtcggacgtagtcgactagtcggagggactagtactacgtctctactactatcgagtcgaccgtctgacgacgtcgtaagtaagttactttacgactttaaatttacttaccgtattacgtaaacttagtttaacttaacgttaaccgtacccgttacggtacgggttaccggtaccgggaaccggaacgggtaaccggtaagggttaaccgaacgtacccggaacgtaacggtcggtacgccgtagtacccg

SEQ ID NO: 216526 - DNA, 558 bp, Homo sapiens
  misc_feature: GYAE6OF02GK5QV.1.34.D01.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattgganacagagtcaccatcacttgccgggngagtcaggccatcagcgattctttagccttggttgcagcaagaaaccgagggcgacgacccctaagatcgtagtctagtggtncatccagtattgacgtaagggtcggggtacccataccgaggttcaggtgcgagtgcngtcgtaggacagattacactctacactntcagcacgcctgacagcctagaagttntttcgacttaatttatacttgtactaacgtattacttataccgtaacccgtacgtacggtaccgttacggaccggtaacggggaaccgtaagggtacggtaacgtaccgaaccggtacgtaggtcggacttacgctaaccg

SEQ ID NO: 216527 - DNA, 516 bp, Homo sapiens
  misc_feature: GYAE6OF02H2JZK.1.34.D01.1.454.CMB.1.raw
  modified_base (188)..(188): a, c, t, g, unknown or other
  misc_feature (188)..(188): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (480)..(483): a, c, t, g, unknown or other
  misc_feature (480)..(483): n is a, c, g, or t
  modified_base (485)..(512): a, c, t, g, unknown or other
  misc_feature (485)..(512): n is a, c, g, or t
  modified_base (514)..(516): a, c, t, g, unknown or other
  misc_feature (514)..(516): n is a, c, g, or t
tcagacgagtgcgtcacgaccggtgctcgatttagatcgtctgtgttgggtttgggagtcaggccatcagcgattctttagcctggttgcagcagaaaccagggcgagcccctcagatcgtagtctatggtgcatccagattgcaaggtggggtcccatccaggttcagtggcagtgcatctgggacngattacactctcactatcagcagcctgcagcctagaagtattttgactaattttataactgtacaacagttattagtactacccctagtggacgtttcggccaaggggggacctaaagggtggaaacgtcgaaacccgtaatcggtacggcttggcctaaccaattccgtcgttacttccaattccctttacccgaccatttacctacggaaaccgctaacgttccgtactggacggtacgggtcgttagggacctaaggcccggactaacgttacggcaggncngatcgannnncnnnnnnnnnnnnnnnnnnnnnnnnnnnncnnn

SEQ ID NO: 216528 - DNA, 584 bp, Homo sapiens
  misc_feature: GYAE6OF02GSNRF.1.34.D01.1.454.CMB.1.raw
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatccacttgccgggcgagtcaggccatcagcgattctttagccttggttgcagcagaaaccgagggcgacgcccctcagactcgtagtctatgggtgcatccagtattcgacgtaagggtcggggtaccccagtcccgaggttccaggtcggcaggtgcatcgtgggacagtattacactctcactatcagcagcctgcagctagaagtattttcgacttaatttattactagtacctaactagttaattaacttaacgttacccctagggttacggtaccggtttaccgggacccggtaacggggtaaacccgtaaggggtaggtaaaccgttacccgaaaccggttaacggttcggtcggtccgttacgacccg

SEQ ID NO: 216529 - DNA, 615 bp, Homo sapiens
  misc_feature: GYAE6OF02IKGO8.1.34.D01.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
  modified_base (367)..(367): a, c, t, g, unknown or other
  misc_feature (367)..(367): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattcgacccagtcctccatccctccctgtctgcatctattgganacagagtcaccatcacttcgccggggcgagtcaggccatcagcgtattctttagccgttggttgcagcagaaaccgagggcgacgccccctacagactcgtagtctaatcggtgacnctccagattgacgaaggggtcgggtcccagttccaggttcaggtcggacngtcgctagtcgtagggaactaggtacttacaccgttctcgaactatccgaggaccacgtcccgtagcctaggacccttagaaacgttattttacggaaccttaaattttacgtttacgtcgttaactaacttaagtttacttaaacgttacccgttaacccgttacggtacggtaccggttccggacgtaacggggaacctaagggtacggtaactaccgaaccgtagtcggtacggtcgtacgaccg

SEQ ID NO: 216530 - DNA, 623 bp, Homo sapiens
  misc_feature: GYAE6OF02I790P.1.34.D01.1.454.CMB.1.raw
  modified_base (221)..(221): a, c, t, g, unknown or other
  misc_feature (221)..(221): n is a, c, g, or t
  modified_base (399)..(399): a, c, t, g, unknown or other
  misc_feature (399)..(399): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccggnagtcaggccatcagcgattcttagcctggttgcagcagaaaccagggcgacgcccctcagatcgtagtctagtggtgcatccagtattcgacgtaagggtcgggtcccagttccgaggttcaggtcggcagttgctagtcgtgggaacagtacttaaccacttctacactactcgacncagtcctgacacgtccgtagtaaagttctttacgacttaaattttactttacgtacgttaactaacgttagttaacttaaacgttaccgttaaccccgttaggttaccgggtaccggtttaccgggaacccgggttaaacggggtaacccgtaaagggggttaccggtaaacgttacccgaaacccgggttaacttacggggtaccggtactaccgggtaaccc

SEQ ID NO: 216531 - DNA, 640 bp, Homo sapiens
  misc_feature: GYAE6OF02HW9FU.1.34.D01.1.454.CMB.1.raw
  modified_base (256)..(256): a, c, t, g, unknown or other
  misc_feature (256)..(256): n is a, c, g, or t
  modified_base (281)..(281): a, c, t, g, unknown or other
  misc_feature (281)..(281): n is a, c, g, or t
tcagacgagtgcgtcacgaccggtgctcgatttagatcgtctgtgttgggtttgggggagtcagaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttggccgggcagtcaggccatcagcgattctttagcctggttncagcagaaaccagggcgagcccctnagatcgtagtctatggtgcatccagattgacgtaaggtcgggtcccagtccgagttcaggtggcagtgcatcgtagggactagtattacgactcgtacactatacgagctacgcctgactacgcctagaaagttgttttcgaacttaaagttttacttaaccgttacgttaacctaaacgttaagtttaacttaaacgttaaacccggtttaacccccttaacgggttacggttaacccgggtttaccgggtaacccgggtaaacgggggtacccgtaaaaggggttaccgggtaaaccgggtttacccgaaaccgggtaaaccgtttacgggttacgggtaccctaggttaaaccccg
